United States Patent 11,739,335 (NUCLEIC ACIDS ENCODING CRISPR-ASSOCIATED PROTEINS AND USES THEREOF) - sequence listing, part 4

SEQ ID NO: 2970 - RNA, 4014 nt, Artificial Sequence
  Cas9 variant
augaagaaagacuacgugaucggccuggauauugggaccaacagcgucggaugggccguuaugacagaggacuaucagcucgugaagaaaaagaugcccauauacgguaauacugaaaagaagaagaucaaaaagaacuucuggggcguaagacuuuuugaggaagggcacacggcugaggauaggcggcugaaacgcaccgcacgacguagaauuuccaggcggcgcaauagauugagguauuuacaagccuucuuugaagaggcgaugacagaccuggaugagaacuucuuugcucggcuacaggaaucuuuccucgugccugaggacaagaaauggcaucgccacccaaucuuugccaagcuggaagaugaggucgcauaccaugagacuuauccgaccauuuaccaccuucgaaagaaacuggccgacucaagugaacaggcugauuugagacucaucuaucuggcacuggcccauauagugaaguacaggggacacuuccucaucgagggcaaauuaagcacagaaaauaccuccguuaaggaccaguuucaacaguucauggugauuuacaaccagacuuuugucaauggugagucucggcuggugucggcuccccuuccugaaucaguauugaucgaggaggaacugacagagaaagccagccguaccaagaaaagugaaaagguucuacagcaauucccacaggagaaggcgaacgggcucuuuggacaguuccugaaacuuauggugggcaauaaggcagauuucaaaaaggucuuuggccuggaagaggaggccaaaauuacguaugcuuccgaaucuuacgaggaagacuuggaggggauccucgccaaggugggagaugaauauagcgacguguuccuggcagcuaagaacgucuacgacgccguugaguuauccacuauacuggcggauucagacaaaaagagucacgccaaacucucuagcuccaugauugugcgcuuuaccgagcaucaggaagaucuuaagaaauucaagagauuuaucagggagaauugccccgacgaauaugauaaccuguucaagaaugagcaaaaagacgguuacgcaggcuauauugcucacgccgggaagguaucacaguugaaauuuuaccaguacgugaagaaaaucauccaagauauugcuggagccgaguauuuccuagaaaagauagcacaggagaacuuucugcggaagcagcgaacauucgacaauggcgucaucccucaucagauucaccucgccgaacugcaagcuaucauacaccgccaggcggcauacuauccauuucuuaaagagaaccaggaaaagauugagcagcuggugacuuucagaauccccuacuauguugguccuuugagcaaaggggaugccaguaccuuugcuuggcucaagaggcaaucugaggaaccaauccggccguggaaccugcaggagacaguggacuuagaucaguccgccaccgcauucauugaacgcaugacgaauuucgacacuuaccugcccagcgagaaaguccuaccuaagcauucgcuccuguaugaaaaauuuaugguguucaacgagcuuacaaagaucucuuacaccgacgauagaggaauuaaggccaauuuuuccggcaaagagaaggagaaaauauucgacuacuuguuuaagacuaggcguaaaguaaagaagaaagauaucauucaguucuaucggaacgaauacaauacagaaaucguuacccugucaggccucgaggaagaccaauuuaacgcuaguuucagcacguaucaggaucugcuuaagugugggcugacccgagccgaguuggaccacccagauaaugcagagaaacucgaagacaucauuaagauacugacaaucuuugaggauagacagaggauucgcacucaguuauccaccuucaaaggacaauuuucugcggaagugcugaagaagcuagagcggaaacauuacacagguuggggcagacucagcaagaaacugaucaacgggauuuaugacaaggagucaggaaaaacuauccuugauuacuugauaaaggacgauggcgucaguaagcacuauaauaggaacuucaugcagcugaucaaugacucccagcucagcuuuaaaaacgcuauucaaaaggcccagucuugcgaacaugaggaaacccugucagagacagugaaugaauuagcagguagucccgccaucaaaaaggggauuuaccagagccugaaaaucgucgacgagcuuguggcuauaaugggcuacgccccuaagcgcauuguuguggagauggcacgagaaaaccagaccacuuccacgggaaaacggcguucuauccaaagauugaagauuguagagaaggcuauggccgaaaucggcucgaaucuccugaaagagcagccaacaaccaacgaacagcuaagggauacucgccuguuccucuauuacaugcagaacgggaaggacauguauaccggagaugagcugagccuucaccgguugucccacuacgacauagaucauaucauuccccaaucauucaugaaagacgauagucuggacaauuuaguccucguggguucuacagagaacagaggcaagagcgaugacguuccguccaaaaagguggucaaggauaugaaagcguauugggaaaagcuguacgccgcugggcuuaucucacagaggaaauuucagcgacugaccaagggagagcagggcgguuugacucucgaagacaaagcacacuucauucaacgccagcugguggagacacggcagaucacgaagaauguagccgggauacuagaucaaagauauaacgcuaagagcaaagaaaagaaagugcagauuaucacccugaaggccucucucacuucccaguuuaggaguaucuucggccuguacaaaguucgugaggucaaugacuaccaucacggacaggacgcauaucuuaacugugugguggcgacaaccuugcugaaggucuacccuaauuuagcccccgaguuuguuuauggcgaauacccaaaguuccaggcuuuuaaagagaacaaggccacagcaaaaacuauuaucuauaccaaucucaugcgcuucuuuacggaagaugagccucgguucaccaaggacagcgagauucuguggucuaacuccuaccuuaaaacaauaaagaaggaacugaauuaucaccaaaugaacaucgugaaaaagguggagguacagaaagggggauuuucaaaggaaaguauuaaacccaaggguccaagcaauaaacuaauccccgucaagaacggccucgauccucagaaguacgggggauucgacucgccagugguugcuuacacugugcuguucacccaugagaaaggcaagaaaccguugauuaagcaagaaauccuggguauaacaaucauggagaaaacuagauuugagcagaaucccauuuuauuccucgaagagaagggguuucugaggccucgaguccuuaugaagcugccaaaauauaccuuguacgaguuccccgaaggccggcgcagacuccuggccuccgcaaaggaagcccagaaaggaaaccagauggugcuaccugagcaucugcuuacgcuccuguaucacgcuaagcaaugcuugcugccaaaccagucugagagcuuagcguacguugaacagcaccagcccgaguuucaagaaauccucgagagggugguagauuucgccgaaguccauacacuggcaaaaucaaaggugcagcagauugugaaacuuuuugaggcuaaucaaaccgccgacgucaaagagaucgccgcuaguuucauacagcugaugcaguuuaacgcaaugggcgccccguccacuuucaaguuuuuccagaaagauauugaacgggcgcgauauacaucuaucaaggagaucuuugacgcuaccauuauauaccaaagcacuaccggguuguaugaaacaagacgcaaaguuguggauuga

SEQ ID NO: 2971 - RNA, 4014 nt, Artificial Sequence
  Cas9 variant
augaagaaagacuacgugaucggccuggauauugggaccaacagcgucggaugggccguuaugacagaggacuaucagcucgugaagaaaaagaugcccauauacgguaauacugagaaaaagaagaucaaaaagaacuucuggggcguaagacuuuuugaggaagggcacacggcugaggauaggcggcugaaacgcaccgcacgacguagaauuuccaggcggcgcaauagauugagguauuuacaagccuucuuugaagaggcgaugacagcucuggacgagaacuucuuugcccggcuacaggaaucuuuccucgugccugaggauaagaaauggcaucgccacccaaucuuugcaaagcuggaagacgaggucgccuaccaugagacuuauccgaccauuuaccaccuucgaaagaaacuggcugauucaagugaacaggcagacuugagacucaucuaucuggcccuggcucauauagugaaguacaggggacacuuccucaucgagggcaaauuaagcacagaaaauauuuccguuaaggagcaguuucaacaguucaugaucauuuacaaccagaccuuugugaauggugaaucucggcuggucucggcgccccuuccugagucaguguugaucgaggaagaacugacugaaaaagccagccguacaaagaaaagugagaagguacuacagcaauucccacaggaaaaggcaaacgggcucuuuggacaguuccugaaacuuaugguuggcaauaaggccgauuucaaaaagguguuuggccuggaggaggaagcuaaaauaaccuaugccuccgagucuuacgaagaggacuuggaagggauucucgcaaaggucggagaugaguauagcgacguguuccuggcugccaagaacguguacgaugcggucgaguuauccacgauccuggccgacucagacaaaaagagucacgcaaaacucucuagcuccaugauuguucgcuuuacugaacaucaggaggaucuuaagaauuucaaaagauuuaucagggaaaacugccccgacgaguaugauaaucuguucaagaacgagcaaaaggacgguuacgcuggcuauaucacccacgccgggaaagugucacaguugaaguuuuaccaguacgugaaaaagauuauacaagauaucgcuggagccgaauauuuccuagagaaaauugcacaggaaaauuuucugcggaagcagcgaacauucgacaacggcguaaucccucaucagauacaccucgccgagcugcaagcuauuauccaccgccaggcggcauacuauccauuucuuaaggaaaaccaggagaaaaucgagcagcuggucacuuucaggauucccuacuauguggguccuuugagcaagggggaugccaauaccuuugcuuggcucaaaagacaaagugaggaaccaauccggccguggaaccugcaggaaacaguugacuuagaucagucugccaccgcauucauugagcgcaugacgaauuucgacacuuaccugcccuccgaaaaggugcuaccuaaacauagccuccuguaugagaaguuuauggucuucaacgagcuuacaaaaauaucguacaccgaugacagaggaaucaaggccaauuuuucuggcaaggaaaaagagaagauuuucgacuacuuguuuaaaacuaggcguaaggugaaaaagaaggauaucauccaguucuaucggaacgaauacaauacagagauuguaacccuguccggccucgaagaggaccaauuuaacgcuucauucaguacguaucaggaucugcuuaaaugugggcugacccgagccgaguuggaccacccagauaaugcagaaaagcucgaggacauaaucaaaauucugacaaucuuugaagauagacagaggauucgcacucaguuaagcaccuucaagggacaauuuuccgcggagguucugaaaaagcuagagcggaagcauuacacagguuggggcagacucucuaaaaagcugaucaacgggauauaugacaaagaaagcggaaagacuauccuugauuacuugauuaaagacgauggcgugucaaagcacuauaauaggaacuucaugcagcugaucaaugacagucagcucuccuuuaagaacgcuauucaaaaagcccagagcucugagcaugaagagacccugucagaaacagucaaugaguuagcagguagucccgccaucaagaaagggauauaccagagccugaagauuguggaugagcuugucgcuaucaugggcuacgccccuaaacgcauugugguugaaauggcacgagagaaccagaccacuuccacgggaaagcggcguucuauccaaagauugaaaauaguggaaaaggcuauggccgagaucggcucgaaccuccugaaggaacagccaacaaccaaugagcagcuaagggacacucgccuguuccucuauuacaugcagaacgggaaagacauguauaccggagaugagcugagccuucaccgguugucccacuacgacauugaucauaucauuccccaaucauucaugaaggacgauagucuggacaauuuaguacucgucgguucuacagaaaacagaggcaaaagcgaugacgugccguccaaggagguugugaaagauaugaaggcguauugggaaaagcuguacgccgcugggcuuaucucacagaggaaauuucagcgacugaccaagggagagcagggcgguuugacucucgaagacaaagcacacuucauacaacgccagcuggucgagacacggcagauuacgaagaauguggccgggauccuagaucaaagauauaacgcuaaaagcaaggagaagaaaguacagaucauuacccugaaggccucucucacuucccaguuuaggaguaucuucggccuguacaaagugcgugaaguuaaugacuaccaucacggacaggaugcauaucuuaacugcgucguggcgacaaccuugcugaagguguacccuaauuuagcccccgaguuugucuauggcgaauacccaaaauuccaaacauuuaaggagaacaaggcuacugccaaagcaauuauauauaccaaucuccugcgcuucuuuacggaggacgaaccucgguucaccaaggacggggagauccuuuggagcaacucuuaccugaaaacaauuaagaaagaacuaaauuaucaccagaugaacaucguuaagaagguggaggugcagaaaggagguuuuuccaaggaaucaauuaaacccaagggcccaaguaauaaacucauccccguaaagaacgggcuggauccucagaaauacggaggcuucgacagcccaauagucgcuuacacuguguuguucacccaugagaaggguaagaaaccgcugaucaagcaagagauuuuagggaucacaauuauggagaaaacuagauuugaacagaaccccauccucuuccuggaagagaagggcuuucuuaggccucgaguucugaugaaauugccaaaguauacccucuaccaguuccccgaaggacggcgcagacugcuagccucggcaaaggaggcccagaaaggcaaucaaauggugcugccugagcaccuucucacgcuguuguaucaugcuaagcagugucuguuaccaaaccaguccgaaucucucgcguacgucgagcagcaccaacccgaauuucaggagauacuggaaagggugguugauuucgccgaggugcauacacuugcaaaaagcaagguacagcaaauugucaaacuguuugaggcuaaucagaccgccgacgugaaggaaaucgccgcuucauucauccaguugaugcaguuuaacgcaaugggggccccgaguacuuucaaguuuuuccaaaaagauauugagcgggcgcgauauacauccauaaaggaaaucuuugacgcuaccauuaucuaccagucuacuaccggacucuaugagacaagacgcaaaguggucgauuga

SEQ ID NO: 2972 - RNA, 4014 nt, Artificial Sequence
  Cas9 variant
augaagaaagacuacgugaucggccuggauauugggaccaacagcgucggaugggccguuaugacagaggacuaucagcucgugaagaaaaagaugcccauauacgguaauacugagaaaaagaagaucaaaaagaacuucuggggcguaagacuuuuugaggaagggcacacggcugaggauaggcggcugaaacgcaccgcacgacguagaauuuccaggcggcgcaauagauugagguauuuacaagccuucuuugaagaggcgaugacagaccuggaugagaacuucuuugcucggcuacaggaaucuuuccucgugccugaggacaagaaauggcaucgccacccaaucuuugccaagcuggaagaugaggucgcauaccaugagacuuauccgaccauuuaccaccuucgaaagaaacuggccgacucaagugaacaggcugauuugagacucaucuaucuggcacuggcccauauagugaaguacaggggacacuuccucaucgagggcaaauuaagcacagaaaauauuuccguuaaggagcaguuucaacaguucaugaucauuuacaaccagaccuuugugaauggugaaucucggcuggucucggcuccccuuccugagucaguguugaucgaggaagaacugacugaaaaagccagccguacaaagaaaagugagaagguacuacagcaauucccacaggaaaaggcgaacgggcucuuuggacaguuccugaaacuuaugguuggcaauaaggcagacuucaaaaagguguuuggccuggaggaggaagccaaaauaaccuaugcuuccgagucuuacgaagaggauuuggaagggauucucgccaaggucggagacgaguauagcgauguguuccuggcagcuaagaacguguacgacgccgucgaguuauccacgauccuggcggacucagauaaaaagagucacgccaaacucucuagcuccaugauuguucgcuuuacugaacaucaggaggaccuuaagaaauucaagagauuuaucagggaaaauugccccgaugaguaugacaaccuguucaagaaugagcaaaaagaugguuacgcaggcuauaucgcucacgccgggaaggugucacaguugaaauuuuaccaguacguaaagaaaauuauacaagacaucgcuggagccgaauauuuccuagagaagauugcacaggaaaacuuucugcggaagcagcgaaccuucgauaauggcgugaucccucaucagauacaccucgccgagcugcaagcuauuauccaccgccaggcggcauacuauccauuucuuaaagaaaaccaggagaagaucgagcagcuggucacauucaggauucccuacuauguggguccuuugagcaaaggggacgccaguacuuuugcuuggcucaagagacaaucugaggaaccaauccggccguggaaccugcaggaaaccguugauuuagaccaguccgccacagcauucauugagcgcaugaccaauuucgauacguaccugcccagcgaaaaagugcuaccuaagcauucgcuccuguaugagaaauuuauggucuucaacgagcuuacuaagauaucuuacacagacgacagaggaaucaaggccaauuuuuccggcaaagaaaaggagaaaauuuucgauuacuuguuuaagaccaggcguaaagugaagaagaaagacaucauccaguucuaucggaacgaauacaauacugagauuguaacacugucaggccucgaagaggaucaauuuaacgcuaguuucagcaccuaucaggaccugcuuaagugugggcugacgcgagccgaguuggaucacccagacaaugcagaaaaacucgaggauauaaucaagauucugaccaucuuugaagacagacagaggauucgcacacaguuauccacuuucaaaggacaauuuucugcggagguucugaagaagcuagagcggaaacauuacaccgguuggggcagacucagcaagaaacugaucaacgggauauaugauaaggaaucaggaaaaacaauccuuggcuacuugauuaaggacgauggugugaguaagcacuauaauaggaacuucaugcagcugaucaaugacucccagcucagcuuuaaaaacgcuauucaaaaggcccagucuucagagcaugaagagacucugagugaaaccgucaaugaguuagcagggagccccgccaucaaaaagggcauauaccagucccugaaaauuguggaugagcuugucgcuaucaugggauacgccccuaagcgcauugugguugaaauggcacgagagaaccagacaaccucuacuggcaaacggcguucgauccaaagauugaagauaguggaaaaggcuauggccgagaucgggagcaaucuccugaaagaacagccaacgacaaacgagcagcuaagggacacccgccuguuccucuauuacaugcagaacggaaaggacauguauacuggugaugagcugucccuucaccgguugucacacuacgacauugaucauaucauuccccaaaguuucaugaaagacgauucucuggacaauuuaguacucgucggcagcaccgaaaacagagggaaguccgaugacgugccgucaaaagagguugugaaggauaugaaggcguauugggaaaaacuguacgccgcuggacuuaucagccagaggaaguuucagcgacugacaaaaggcgagcaggguggguugacccucgaagacaaggcacacuucauacaacgccagcuggucgagacucggcagauuacgaaaaauguggccggcauccuagaucaaagauauaacgcuaauucuaaggagaagaaaguacagaucauuacacugaaggccucccucaccagucaguuuaggagcaucuucggacuguacaaagugcgugaaguuaacgacuaccaucacggccaggaugcauaucuuaauugcgucguggcgacuacauugcugaagguguacccuaacuuagcccccgaguuugucuauggggaauacccaaaauuccaaaccuuuaaggagaauaaggcuacagccaaagcaauuauauauacuaaccuccugcgcuucuuuaccgaggacgaaccucgguucacgaaggacggagagauccuuuggucuaauuccuaccugaaaaccauuaagaaagaacuaaacuaucaccagaugaauaucguuaagaagguggaggugcagaaagguggcuuuucaaaggaaaguauuaaacccaaggggccaagcaacaaacucauccccguaaagaauggacuggauccucagaaauacggcgguuucgacucgccaauagucgcuuacacaguguuguucacucaugagaaggggaagaaaccgcugaucaagcaagagauuuuaggcaucaccauuauggagaaaacaagauuugaacagaaccccauccucuuccuggaagagaagggauuucuuaggccucgaguucugaugaaauugccaaaguauacucucuacgaguuccccgaaggccggcgcagacugcuagccuccgcaaaggaggcccagaaagggaaccagauggugcugccugaacaccuucucacccuguuguaucaugcuaagcaaugucuguuaccaaaucagucugagagccucgcguacgucgaacagcaccagcccgaguuucaagaaauacuggagagggugguugauuucgccgaggugcauacgcuugcaaaaucaaagguacagcagauugucaaacuguuugaagcuaaccaaacagccgacgugaaggagaucgccgcuaguuucauccaguugaugcaguuuaaugcaaugggagccccguccaccuucaaguuuuuccagaaagauauugaacgggcgcgauauacuucuauaaaggagaucuuugacgcuacaauuaucuaccaaagcaccacuggccucuaugagaccagacgcaaaguggucgauuga

SEQ ID NO: 2973 - RNA, 4017 nt, Artificial Sequence
  Cas9 variant
augcaggacuacuaucugggccucgauaucgggaccaacagcgugggaugggccgucacagacgagaauuacaaccuucugagaaagaaagguaaggauuuguggggcguuagguuauucaaagaagcucaacccgcaacugagcggcgcgggcaccgauccucucguagaaggacgauucggaagucacugcgcaaacagcuacucagagaacuguuugaggaagagauaaaugccaucgacaaggauuucuuucuuaggcuggacgagaguaaguauugguuggaagauaaaaagauugagggaaaauacagccucuucaacgacgaaaauuuuaccgauaaggacuauuacgagaaauucccuacaaucuuucaucugcggaaggcgcugauugaguccgaugacaaggaagauauccgccucuauuucuuagcuauaaaccagaugaugaaacgaagaggccacuuucugaucgacgguaaacuuucuaauguggaggacauuacuccauucaaagaaugcauccagaacuugauuaaugaggaacuggauaccgagaucgagacagaauuuuacgacaaggccauaaaaauuguaucggauuacucacuaaagaaaaccgagaagaagaaccucaucaaagaccuggugaaggaaacugauagcauugaggacaguaaaaagaucaucaauauuuucaaccuucugauauccgggaaaucuaaggucaauggaaucuuugaugacgaagagauuuuggagaagaucaaagaagauaacaaggaggacuucuaucucacaagcgaaaaauacgaggaaaaucuggaguauuucucccaauuacuggauuacagguuugagcucauaucaagucuuaagagcauuuaugacuacaucauccugcaggaaguguugaaaggcaagaaguaucuaucuuacgcacagguugagcgguacaaaaaccauaaggaagaccugcguaaacucaagcagcugauuaaaaaguaugauaagaacggcaaaaucuacuaucaaauuuuccgcgacgagaauuuuaagaaaggguacguggccuaucuuggauacuauaagaaaaacaagaaaaaugucccggugaagaagugugauuacgacaccuucuccaaaaacauaaagucaacgcuggauaaaaucugcgacaaggaggaucccuuguacauugaacucaucgacaaaaucgagaaggguggcuuucuguuaaagcagauuguaagcacuaauaguguuauaccucaccaggugcaugaacuggagcuagauaaaauccucgaaaaccuggagaagaauuauccaucuuucaaagagauuuccgacggggucagcaagaucgauaaaauuaagaugaucuuuaacuucagaauacccuacuaugugggaccucuuaaugacuaccacaaggauaaagugaacucgaauaccuggaucgucaagaacgaaggcuuugagaaugaaaacauuaggccauggaauuucucuaaaaucguugacgagcacgcuugugaagaggaguuuauuaagcggaugaucaacgaaugcuccuauauacccggugagaaaguguugccuaagucaagucugcucuacagcgaauauaugguacugaacgagcuuaauaaccugcgagugaauggggacaaguugaacccaaaaauuaagaaagaaaucgucgagaauauuuacaagaaagagcgcaaggugacacucaaaaagaucagaaacuuccugauaaucaauaacuacguugauuccaagguggaauuuucuggauuaagcgacggcauuaaagcaaauaugucaaguuauaucgauuucgccgagauucuggacgauaacuucgacaauaacauggucgaagaucuaaucgagcagauaacuauucaugugggcaauguaaagcuccugaccgagaaaaucuccaacaaguacccgaaucuugaaaagaagcaaaucaacaagauuguuaacuugaaauuuaaggacugggcuagguucagccggaaacugcucguggggaucgagggaacagaaaaggagaccggugaaauuaauacgauaaucggcuuucugcgcgagacuaacgagaauuucauggaauuaaugucuaacagauauacauuuucagaggaaauuagugagaucaaaaagaaguacauucccaauaaacugagcaagcagaucgucgaugaccuuuauguguccccugccgucaaaaagaugauauggcaaguguugaacaucaaugaugaacucauuaaaguucuggggaagcagccaaagaaaaucuucauugagauggcgaggggaaaggaggaaaaacccgaggugaaggacucucguaaaaacaagcuaaucgaacuguacaagaaucucggcaaagaggguaaggaauggcugaaccggauagaggauaaaaccgaggcagacuuucgaaauagagcccuuuauuuguacuacacucagauggggagguguauguauacaggcgaaauuaucgacaucgagcgccuguacgauaaggaauuauaugaccucgaucacauuauaccucggaaaaugaagaaagacgauucgauccauaagaaccugguacuugucaccagaaauagcaaccaguacgagaagaaagacaauuauccagugcccgagguuauuaaguccagggaaaacgugcgccaccugugguacgcuuugaaaaagaaaggacucaucacggaggaaaaguauaaccgacugacccggauuaauccgcuaucagauaaggagcugagugaauuuaucgagcgucagcucgucgagacaagacaaacuaccaaagugguaaaggaccuguuugaaaacuacuacacagauucuaaaauagugacuguuaaggccggccuugucagcgaguugaggcgcgacuucgaagugcugaaaugccgggagaucaaugauuuaaaccacgcacaugacgcuuuucucaauauuaucgugggggacgucugguccaagaaguucaccucaaacccuuauaauuuuguuaaaaagaacagagaaaaauacacacugaauaacauuuucaccaagaaucagaaagaucuuaggggaaacgagaucuggaauugugccgaggguaagaagcgaauaauuaaaacucugaacaagcccagcgugcuauucucuguggaaaauuuugagcagacgggccaacucuucgaccagaacaucaucgggaaacaggauuauaaggaaaagacauccuacguaccaauuaagggagacgagcgccugcaggauaucaguaaauauggcgguuaccgggggauaagcggcgcguauuucuucauugucgaacacaccgagaagaauaagagagugaaaacuaucgagucuuugccuauuuacaugaaguccuacguugaagagaacggacuguuagacuuuugcaccaacgaaaugaaacucguggaucccaagaucauagucaaaaagcugaauuauaagucagagauuaucguggacggcuucaaauaccuuaucagugggaagacagagaacaggcugagcuuggaaaccaaugaguaucucuacuggaaccauacucagacaacggauauuaaaaagauccugaauauuaacgagaaaauagaacuagaaaaguauaauggagacaucgagucggagcgugaaaacauuaucaaguacauccaaauuauacuggagaaauuuaaacuuaaaccauucaucaagcgccggaaucuccccaacauugaaaucaauuuugccgauuaugagaccgaaaaacuguugcagcuguuaguuaaccucauuccucugacuacaaaguacguguccccaguagaccuuaccgucaucucugguagcaaguacgcaggcaaagugcugauaccgaagaaaaucucaaauuugaacgaggugauuuucaucaguaaguccauuacagggaucuaugagucuagaaggcgaauaauuuga

SEQ ID NO: 2974 - RNA, 4017 nt, Artificial Sequence
  Cas9 variant
augaagcaggaguacuuccugggccucgacauggggaccggaagccuugguugggccgugacagauuccacuuaucaagucaugagaaaacacggcaaggcucugugggggacgagguuguuugaaucugcaucaaccgccgaggaacggcgcauguuccgaacagcgcguagaagguuagaccggcgcaacuggagaauccagguucugcaggagauuuuuagugaagagauaagcaaaguggaucccggauucuuucuaaggaugaaggaguccaaauacuauccugaagacaagcgggaugcugagggcaauugcccagaacucccguacgcccuguucguagacgauaacuauacugacaagaauuaccauaaagauuaucccaccaucuaccaccuucgcaagaugcugauggagacaaccgagauuccugacauccgauugguguaccucguccugcaucacaugaugaaacauagaggucacuuucugcucucuggggauauuucgcagaucaaggaguucaaaucaacuuuugaacaauuaauacagaacauccaggacgaggaacuggaauggcacauuagccuugaugacgcagccauccaguucguggagcauguuuugaaggacaggaaucugacacggaguaccaagaaaucccgucuaauuaagcaacucaacgcuaaaucugcaugugagaaggccauccugaaucuucugagcggaggcacggugaaauuguccgauauauuuaacaauaaggaacucgacgagucagaacgcccaaaagucaguuucgcugauagcggcuaugacgauuacauugggaucguggaggccgaacuggcggagcaguauuacauuaucgcaucugccaaggcuguauaugacugguccguuuuaguggagauccugggaaacucagucagcauuagugaagccaagauaaaaguguaccagaagcaccaggcagaucucaaaacucuuaagaaaaucgugagacaauauaugaccaaggaggacuacaagagggucuuuguugauacagaagagaaacugaauaacuacucugcuuauauugguaugacuaagaaaaauggcaagaaaguggacuugaaguccaagcagugcacccaggccgauuucuacgacuuccucaaaaagaacguaaucaaagugauagaccauaaggaaauuacacaagagaucgagagcgaaaucgagaaagaaaauuuucugcccaagcaggucaccaaggauaacggggugauuccuuaucagguucacgacuacgagcucaaaaagauccuggauaaccuuggaacgcggaugccauucauuaaagagaaugcggaaaagauacagcaacuguuugaguuccgaauccccuauuacgugggcccuuugaaccgcgucgacgaugguaaagacgggaaguuuacuuggucggugagaaaaucugaugccaggauuuauccauggaauuucacagaaguaaucgacguugaggcauccgcugaaaaguuuauccggcgcaugaccaacaaguguacuuaccucgugggagaggauguccugccgaaagacucauuaguguacaguaaguucaugguccugaaugagcuaaacaaucucagacugaacggcgagaaaauuagcguggaacuuaagcagaggauauaugaagaguuguuuugcaaauaccguaagguuacacggaagaaacuggaacgauaucucgugaucgagggcauugccaagaaagggguagagaucaccggaauugauggugacuucaaggcuucccugacggccuaccacgauuuuaaagaaagacuuaccgacguccagcugucucagagggcaaaggaggccaucguguugaauguugugcuauucggcgacgauaagaaacuguuaaagcaacgccugagcaaaauguaucccaaccuaacaacugggcagcucaagggaauauguucacugaguuaccagggcuggggucggcuuuccaaaaccuuuuuggaagagaucacagucccugcuccagggacuggcgaaguguggaauauuaugaccgcgcuguggcagacaaacgacaaucucaugcaacuguuaagcagaaacuauggauucaccaaugagguagaggaguucaacacucugaagaaggaaacggaucuuucuuacaaaacaguggacgaauuguacguuucacccgcagucaagaggcagaucuggcagacccucaaaguggugaaggagauucagaaagucaugggcaacgccccuaagcgcguuuuuguggagauggcucgagaaaaacaagaggggaagcggagugauagccguaagaaacagcugguggaacuauauagagccugcaagaaugaggaaagggacuggaucacugagcugaacgcacaguccgaucaacagcuccgcucugacaaacuguuccuuuacuauauacagaagggacgguguauguacucgggugagaccauucaguuggaugaacugugggacaauacaaaauaugauaucgaccauauuuacccacaaagcaagaccauggaugacuccuuaaacaauagaguacucgucaagaaaaacuauaaugccaucaagucagacacuuacccccugagucuugauauacagaaaaagaugaugucuuuuuggaaaaugcugcagcagcaaggcuucaucacaaaggagaaguacgugagguugguucgaagcgacgaacucuccgcugaugagcuggccggguuuauugaacgccagaucguggagacgcggcagucaaccaaagcagucgcgacuauucuaaaggaggcucugccggacacagaaaucguguauguuaaagccggaaacgugagcaauuucagacagaccuacgagcuccugaagguaagggaaaugaacgaucuucaccaugcaaaagacgccuauuugaauauagucgugggcaacgcuuacuuugugaaguucacaaagaaugccgcaugguuuauucguaacaauccuggucgcucuuauaaccugaaacggauguucgaguuugauaucgaaagauccggggagaucgcuuggaaggccggcaacaaaggaaguauugucacuguuaagaaagugaugcaaaagaauaacaucuuaguaaccaggaaggcguacgaggugaaaggcggguuguucgaccagcagauuaugaagaaaggaaagggucaaguccccauaaaaggcaaugaugaacgacuggccgacaucgagaaguaugggggauacaacaaagcugcaggcacguacuuuaugcuuguuaagagccuggauaagaaagguaaggaaauucggaccaucgaguucgugccacuauaucucaaaaaucagauugagaucaaccacgaaucugccauacaguaccuggcucaggagcgcgggcucaauuccccugaaauccuguuaucaaagauuaaaaucgacacacucuucaagguggacggcuuuaagauguggcugaguggaagaacuggcaaccaacuuauuuucaaaggggccaaucagcugaucuugagccaucaggaggcagcgauacucaagggagucgugaaauauguuaacaggaagaaugaaaacaaagaugccaagcugucggagcgggacggcaugaccgaggaaaagcuacugcagcuuuacgauacauuucucgacaaacuguccaauacuguguauucuauucgauugagcgcucaaaucaagacccugacggagaaaagagccaaguucaucgguuuaucaaacgaagaucagugcauuguccucaaugagauacugcacauguuucagugucagaguggguccgcaaaccuuaaacugaucggaggccccgguucugcuggcauuuugguaaugaacaauaacaucacagccugcaagcaaauuagcgugaucaaucaguccccaaccgggauauacgaaaaggagaucgaccucauuaaacuguga

SEQ ID NO: 2975 - RNA, 4017 nt, Artificial Sequence
  Cas9 variant
augaccaagcccuacagcaucggccuggacauugggacaaacuccgugggaugggccgucguuacugaugguuauaaagugccugcuaagaaaaugaagguacucggcaauacggacaaaucucacauaaagaagaaccuucugggggcauuguuauucgauucaggaaauaccgccaaagacagaaggcugaagcggacagcgcgccgacguuacacuagaaggcggaaccgcauccuauaucuccaggagauuuuugcugaagagauggccaaagcagaugaaaguuucuuucaaagacugaaugagagcuuccuuaccaacgacgauaaggaauuugacucccauccaaucuucggcaauaaagccgaggaggaagcucaccaucacaaguuuccgacaauuuuccaucugaggaagcacuuggcagauucuaccgagaaaucggaccuccggcugaucuaccuggcccucgcucacaugauaaaguuucgcggucauuucuuaaucgaagggcagcugaaagccgagaacacuaaugugcagacacuuuuugaugacuucgucgagguguaugauaagaccguugaagagucacacuugagcgaaauuaguguguccucuauccugacggagaaaauuagcaagucccgaagacuagaaaaccucaucaaauacuaucccacugagaagaagaauacccuguuuggaaaccuuauagcgcugucauugggccuccagccuaauuucaaaacaaacuucaagcugagugaggacgcaaaauuacaauuuagcaaggacacuuacgaagaggaucugggcgaacuccuugggaaaauuggagacaauuacgccgaucuguucaucucugcuaagaacuuguaugacgccauucuacuguccgguauccucaccaucgaugacaacacaaccaaggcaccacugucagcuagcaugauuaaaagguacgaggaacaucaggaggaucuugcccagcugaagaaauuuauacggcagaauuugcccgaccaauauagugaggucuucucugauaagacgaaagacggcuacgcgggguauaucgauggaaagacuaaccaggaagccuuuuacaaguauauuaaaaauaugcucuccaagacagagggcgcagacuacuuccuggacaaaaucgaucgugaagacuuuuuacgcaagcagagaaccuucgauaacgguagcgugccucaccagauacaucugcaagagaugcacgcuauucuaaggcggcagggggaauacuauccauuucucaaagagaaucaggacaagaucgagaagauccugacuuuccgaauacccuacuauguaggaccucuugcccgcaaaggcucgagauuugcuugggccgaauacaaggcagauaaaaagguuacaccauggaacuucgacgauaucuuggacaaagagaagucugccgaagaguuuauuaccaggaugacgcugaaugaucucuaucugccggaggaaaaagugcuucccaagcacucccuggucuacgagaccuucaacguguauaaugaauugacaaaggugaaauacgucaacgagcaaggcaaggcuauauucuuugacgcgaauaugaaacaggaaaucuucgaucauguuuuuaaggagaaccggaaagugacuaaggacaagcuccugaauuacuuaaacaaagaguucgaagaguuucgcauuguaaaucugaccgggcuagauaaggaaaacaaagcauucaacucaagucucggaacauaucacgaccugagaaagauccuugacaagagcuuuuuggaugacaaggugaaugagaagaucauugaagauauaauccagacucugacccucuucgaggacagggagaugauucgucagcggcugcaaaaauacuccgauaucuuuacaacccagcaguuaaagaaacuggaacgaagacauuauacugguuggggcaggcuuucugccaaguugauuaacgggauccgcgacaaacagagcaauaagacgauacucggauaccugaucgaugacggcuauucaaaccggaauuucaugcaacuaauuaacgaugacagucugccuuuuaaggaggaaaucgcuagagcccaggucauuggugagacagaugaccucaaucagcugguguccgauaucgcagggagcccagccauaaagaagggcauucuucagucuuugaaaaucguugacgaacuggugaaggucaugggacacaaccccgcuaauauugugaucgagauggccagggagaaccaaaccacugcaaaaggccgccgaucaagucagcagcgguacaagcguuuagaagaggcgauuaaaaaucucgaccacgaucugaaccauaagauccuuaaggaacacccuaccgacaaucaggcucugcaaaacgauagauuguuccucuauuaccugcagaaugggagggacauguacacagaggauccacuagacauuaaccgccugagcgauuaugacaucgaucauauuaucccccaguccuuuauaaaagacgauucuauugacaacaagguacucguuucgagcgccaaaaaucggggaaaguccgacaacgugccgucagaggaugucgugaauagaaugaggccuuucuggaacaaacugcuuaguugcgguuugaucucucaacgaaaguacagcaaucugaccaagaaagaauuaaagcccgacgauaaagcaggcuucaucaagcgccagcucgucgagacucggcagauuacaaaacacguggcccagauccuggacgcuagauuuaacacgaagagggaugaaaauaagaaaguuauucgugacgugaagauaaucacccuuaaauccaaccugguaucacaauuccgcaaggauuuuaaauucuauaagguccgggagauuaaugacuaccaccaugcccacgaugcauaucuaaacgcugugaucgggaaggcccuccuggacguuuacccacaguuggaaccugaguuuguguauggagaguacccccauuuccacggcuacaaagaaaauaaggcgacugccaaaaaguuuuucuauagcaacauuaugaacuuuuucaaaaaggaugacaucagaacagaugagaauggugaaauagucuggaagaaagacgagcauaucucuaauauuaagagggugcuguccuacccacagguaaacaucgugaaaaagguugaaauucagaccgucgggcaaaacggcggauuauuugacgauaaucccaaaaguccucucgaggugacaccaagcaagcuggugccgcuuaaaaaggagcugaaccccaagaaauauggcggguaccagaagccuacuaccgcuuauccagucuugcucaucacggacaccaaacagcugauacccauuucuguuaugaauaagaaacaguucgaacaaaacccugugaaguuccuacgagaucggggauaccaacagguggguaagaaugacuuuaucaaacugccaaaguauacacuuguagauaucggcgacgggauuaaacgccucugggcauccucaaaggagauacacaaaggaaaccagcuggucgugaguaaaaagagccagaucuugcuguaccacgcccaucacuuagauucggaccucuccaaugauuaccugcagaaccauaaucagcaauucgacguucuuuuuaacgaaauuaucucuuucagcaaaaaguguaaacugggcaaggagcacauucagaaaaucgaaaauguguauucaaacaagaagaauagugcuuccauagaggaguuggccgaaucuuuuaucaaacuccuggguuucacucagcuaggggcaaccagccccuuuaacuuccugggcgucaaacuuaaucagaaacaauacaagggcaaaaaggauuauauucucccgugcacagagggaacucugaucagacaguccauuaccggguuguacgaaacgaggguggacuuaucaaaaaucggagaggauuga

SEQ ID NO: 2976 - RNA, 4017 nt, Artificial Sequence
  Cas9 variant
augagagacuacuauaucggccuggaucucgggaccggaagccuugguugggccgugacagacagggaguacgaaauuaugcgggcucacggcaaggcacuguggggaguccgcuuguucgauuccgccaacacugcggaggaacgacguggguuuagaacggcuaggcggcgcuuagacagaaggaauuggcggauagagcugcuacaggaacucuucggcgaggauaucgguaaaguugacucuggguuuuuccugcgcaugaaggagucaaaauauaugcccgaagauaagcgagacgugaacggaaauugcccuaaacuuccauacgcccuguuuguagaggauggcuauaccgacaaggauuaccauagacaauucccgacaauuuaucacuugaggaaguggcucauggaaacugaggagacccccgacauccggcugguguaccuggcacuccaucacaugaugaaacaucguggccacuuuuuauucagugggaacauugaaaagaucaaagaguuucaggaaacauuccgccaguacauaggaaagaucagagaggaagaacuggauuuucaccuuuguauugagggugaagaguugagggaaaccgagaauauccugaaagacaagaaccuaacucggagcgccaagaaaacacgacucauuaagcugcuuggcgcucauaccgcaugcgaaaaagccgcucugaauuuggucgccgggggaacggugaagcucuccgacaucuucggcaacucugagcuggaugcgugugagaaaccuaaguuaucguuugcagacgccgguuaugaugacuacgcugggaugauagaagaugagcugggagaacagcacguuauuaucgagacugccaaagcaguguaugacuggucaguccucgcugauauucuuggcgacuaccgcugcaucagcgaagccaaggcggccguguaugagaagcaucaaaaagaucugagacacuugaaggagcuaguaaaagaaaaucugggcagggacguuuacaaggagguguucgucaaaaccaacgaaaagcucccaaauuauagugcauacaucgggaugacaaagaaaaacggagugaaguccgagauggaggguaaacggugugaucgcaaggcuuucuacgacuaucugaaaaagacuguggucaaugccauucccgacgaaucuaagaccgaguaccuuagaaaagaaauggagacagaaaccuuucugccuaggcagguuacgaaggauaacggcgugauaccacaccagguacauuugcaggagcucgacgcuauccuggagaauuuaagcgggcguauucccgcccugaaagaaaacggauccaagauccgggauauauucacuuuucgaaucccuuauuacgugggcccacuaaacgguauugucaaagggggcgagagaacaaauugggugaggcgcaagaaggcaggacggaucugcccguggaacuucgacgaaaugguugauaccggcgccucagcugaggaauuuauuagaaggaugacaaguaaauguacuuaucucauccacgaggacgugcugcccaagaauagcaugcuuuacucuaaauucauggucuugaacgagcugaauaacgugcgccucaauggggaaccuauuuccguagagcugaagcagaaaaccuaugaagaucuuuuucaacgacaucggaagguuacgcguagaaggcugaccgacuacauacgccgggagggaaucgcggguagagaugcagacauuacaggcaucgauggggacuucaaaggaucauugacugccuaccacgauuuuaaggaaaagcucaccggcugcgagcugagccaggcugacaaagagaacaucauuuuaaauauaacacuguucggugaagacaaggcccuacucaaaaagaggcugggggcacuuuauccagccuugacugagccccagaaaaaggcuaucugugcccugaguuacaagggcuggggacgacucucucaacgccuguuagaaggcauuaccgcgccugcaccagagacaggggagaucuggaccgugauucgggcuaugugggaaacuaacgauaaucugaugcagguccuuuccgagaaauauugcuuugccgcagccaucgacgaagagaacgcuggagaagaguugaaggagauaacguacaaaacaguggaacagaugaaugucagccccgccgugagaaggcaaaucuggcagucgcuccagguuauuaaggagaucuguaaagugauggguggcccgccuaagcguguauucgucgaaauggcacgcgagaagauggaaucuaaacggaccgaguccagaaagaaaaggcugauugaucuauauaagaaaugccgagaggaagaacgggacuggaucgaggagcuggggaacacugaagagacccgccucagaucagauaagcuguaccuuuauuacacacagaagggaaggugcauguacaguggcgaggugauagaauuggaggaacugugggacaaucggaaauaugauauugaccauaucuacccccaaagcaagguuauggaugacuccuuagauaaccgagugcucgucaaaaaggaguauaacgcugacaaaaccgaugaguacccaauuagagccgacauccgcgguaagaugagggcguuuuggcguauacugcgggaagagggguucaucucuaaagaaaaguauaauagacuuacuaggggcacaggauucgagccuagcgaacuggccggcuuuauugcucgccaguugguggagacgcgacaggggaccaaggcaguagccucagugcucaaacagguuuuccccgagacugacaucgucuacgcuaaggccagaguggcaagucaauuucggcaggaguucgaucugauuaaagugagggagaugaacgaccuacaccacgcgaaggaugccuaugucaauaucguugugggaaacguguacuacacaaaauuuaccuccaaugcugccugguauguaaaggaacauccaggccgcagcuacaaccugaagaaaauguucacaucugagcgugacgucgcaagaaauggugaaacugcuuggcgggccgggaacucaggaaccauagcaacggugaagaggguuaugggcaaaaauaacauucucgugacccgccgaaguuaugaggucaaggguggccuguuugaucagcagcuuaugaaaaaggggaagggacaagugcccaucaaaggcagagacgagcgguuggccgauaucgacaaguacgggggauauaauaaagcugcgggcacauacuucaugcuggccgaaagcgaggauaagaaaggugcaaagauuagguccguugaauaugugccuuuauaccucuguaacugcaucgagaaggacgaagaggcugccaaaaaguaccugcagaaagagcgcgggcuuaagaauccaagaguacugauugccaaaauaaagaucgauacucuauuuaaggucgacggauucuauauguggcucucuggcaggaccgguaaccagcugauuuuuaaaggcgcuaaucaguugauccugucggaaccggacaugcggauuuuaaagaaagugcucaaguacgugaaccguaaaaaggagaacaaaaaugcaguccugggggaacacgaucaacuucccgagacagaccugauccgcuuguaugauguuuuccucgacaagauagagaacacuguguaccauguacgacugagcgcccagcagggaacccuaacgaagaauaaagauacauuuugugaacuguccaacgaggacaagugcaucgugcuuucagaaauucuccacauguuccaaugucagaguggcucugcgaaucugaaauugaucaaggggccuggaagcgcuggcauucuggucuuaaacaauaucauauccaaaugcaaccaggugucaauuauccaccagagcccaaccgguaucuaugagcaagaaauugaucucaagaagauauga

SEQ ID NO: 2977 - RNA, 4020 nt, Artificial Sequence
  Cas9 variant
augaacaaggccuacacccugggccucgacaucgggacaaauagcgugggaugggcugucguuacugaugacuauagacuuauggcgaaaaagaugcccgugcacuccaaaauggagaagaaaaagauuaagaaaaacuucuggggugccaggcuguuugaugaaggccagacggcggaggaacggcgcaauaagcgagcuacccguagaagguugcggcgcagaaaauacaggauauuagagcugcaaaagaucuucucugaagagauucuaaagaaggacucacacuuuuucgcccggcucgaugagaguuuucugaucccugaagacaagcaguaugcacgcuucccaauuuuuccgacacuucuggaggaaaaagccuacuaucagaacuaccccacuaucuaucacuugcgacagaagcucgcugauagcaccgagaaagcagacauaagacugguauaccuggcccucgcucauaugaucaaguacagggggcacuucuuauuugagggagaacuggauacagagaauaccuccguggaagagacuuucaaagaauuuauugacaucuauaacgagcaauucgaggaaggcauuaucuuuuacaaggauauaccucuuauuuugacagacaaacugucuaagucgaagaaagucgagaagauccuacaguauuacccaaaagaaaagaccacggguugccucgcccaguuccugaaacuuauuguggggaaucagggaaacuucaagcaagcguuucaucuggaugaggaaguuaagauccagaucucaaaagagacuuaugaggaagacuuggagaagcuccugcggaaaagcaaugaagagaugauugacguguucuuacaggucaagaaaguguacgaugcaauacugcucagugacauccuuuccaccaagaugaaggauacaaaagccaagcugucugcuggcaugauugaacguuaucagaaccacaaaaaggacuuggaggagcuaaaacaauuuguacgcgcccaucugcaugaaaagguuacuguguucuuuaaggauagcuccaaagacggcuacgcaggguacaucgauggaaagaccacacaggcugacuucuauaaauuucucaagaaagagcugaccgguguccccggcucagaaccuaugcuugccaagauagaucaggagaauuuccuguugaaacaaagaacgccaacuaacggggugauuccccaccaggugcaucucacagaguuuaaggcgaucaucgaccagcagaagcaauacuauccuuuccuggaaaagaguaaggagaaaaugauucaguuacugaccuuuaggaucccauacuaugucggaccgcuagcccaggauaaggaaacuagcucuuucgcauggcucgagcggaaaacaaccgaaaagauuaagcccuggaaugcuaaagacguuauagacuacggcgccuccgcuacgaaguuuauccagcgaaugauuaacuaugauaccuaccugccuacagagaaagugcuuccaaaguacucaauguuguaucaaaaauacacuaucuucaaugagcugaccaagguagccuauaaggacgaucgcgguaucaaacaccaguucagcagugaagagaagcucagaauuuuucaggaacuguucaaaaagcagaggcgggugacaaagaagaaacuucaacacuuucugucugcaaacuacaacauagaggacgccgaaaucuugggggucgauaaaguguucaauuccagcuaugcuacuuaccaugacuuucucgagcuggcgaagcccuauaccgagaaaauuaucgaauuacuggagcagccugaaauggaggaaauguucgaggauauuguuaagaucauaacaaucuuugaggaccgcgaaauggugagaacccagcucaaaaaguaccagaggauucuaggagaggaaaucuucaaaaagcuggucaagaaaaaguacacuggcuggggccgucuuucgaaacgguugauuaacgggauccgagaucaaaagacgaauaaaacaauacuggacuaucucauuaacgaugacgauuuuccauacaauagaaacaggaauuucaugcagcugaucaacgacgaccacuuaucuuuuaaggaggagauugcaaaggaacugacccuuuccgauaaacagucauugcucgaggugguagaagccauccccggaaguccggcuauaaagaaagguaucuggcaaacucugaagauuguugaggaacuaaucgccauuaucggcuauaaaccuaagaauauagugauugagauggcacgcgagaaccagaccacaaccgggggaaagaaucggagcaaacccagacugaagucccucgaagaggcccugaaaaacuucgacucucagcuuuugaaggaaaggccagucgauaaucagagccugcaaaaagaccgcuuauaccucuauuaccugcagaacggcaaggauauguauacuggugagucacuugacaucgaucgacugagugaauacgacaucgaucauauuaucccucgguccuuuauuguggaccacagcuuggauaauaagguccucgugucuucaaaagagaaccgucugaagaaagacgauguucccgacaguaaggugguaaaaagaaugaaggcuuacugggagaagcuacugagggccaaccucauaagcgaacgcaaauucuccuaucugacaaaacuugaguugacggacgaugacaaagcacgguucauccagagacagcuggucgaaaccaggcaaauuacuaagcauguggcggcuaucuuacaccaguacuuuaaucagacacaggagcucgaaaaagagaaggauauucgaaucauaacccugaaaucuucgcuuguuagccaauuccgccagguguuugggauccacaagguccgggagauuaaccaucaccaucacgcccacgacgcauaucugaaugccgugguagcucuagcccuccugaagaaauacccaagauuggcacccgaguucguguauggcuccuuugcuaaguuccaucugguuaaagaaaacaaggccacagcgaaaaaggaauuuuacucaaauaucuuaaaguucuuugagaaagaggaacaguucugugaugagaacggagaaaucuuuugggacaagaggaaacacauucaacagauaaagaaagucauuaguucucaucaggugaauaucgugaagaaggucgagguucagacuggcagcuucuauaaagaaaccgugaacacgaaggagaaaccugauaagcucaucaaacguaagaauaacugggacgugaccaaguacgggggauucgguuccccaguagucgccuacgcugugguuuuuacauaugagaaaggcaagaaucacaaaaaggcaaaagccauugaagggauaacuaucauggagcaagcucuguucgaaaaggauccgauuucauuucuuaucgagaaaggauacagcaacgugaaucaguucauuaagcugcccaaguauaccuuguuugaacucgccaacggccagcgccggaugcuggcaucucaucaggagcuacaaaaagcaaauuccuucauccugccugagaaacuugucacacuccuguaccacgccaaccacuaugacgaaauagcuuacaaagauaguuaugacuacgugaacgagcauuuuagcaauuuccaggacaucuuggauaagguuauuaucuuugccgaaaaauacacuucugcaccacagaagcugaaccagauuaucgcuaccuaugagaagaaucaagaagccgacagaaaaauaauggcacacuccuucgugaacuuaaugcaguuuaaugcccucggugcucccgcggauuucaaguuuuucgacacgacaauuaccaggaaacgauacacuucacugacagagaucuggcagaguaccaucauuuaucagagcguaacugggcuuuacgagacccggcgcagaauggccgaucugugggacggcguccaauga

SEQ ID NO: 2978 - RNA, 4020 nt, Artificial Sequence
  Cas9 variant
auggagagauaccacaucggccuggacauugggaccagcuccauaggaugggccgugaucggugaugacuucaagauuaaaaagaaaaagggcaaaaaccucaucgggacaaggcuuuuuaaugaaggagcuacugcagccgagcggcgcggcuuccgaacgcagcguagaaggcugaaccggcgcaaguggagauugaaguuacuggaagagauuuuugaucccuauauggcggaagucgacgaguacuucuuugcuaggcuaaaaucuucaaaucucaguccuaaggauagcaacaaaaaguaucuggguucccuucuguucccagacaaaucugauucgaauuuuuacgacaaguauccgaccaucuaccauuugcggcgcgaucucauggagaaggacgaaaaauucgaucugcgagagauauaucuggccauccaccauauuguuaaguacagagggaacuuucucgaaaaagugcccgcaaagaauuacaaaaacucaggagccagcaucggcuucuuacuggaggagguaaauagucuuuauaaggacauuaucggcgaugaauccauagcuauuuugaacucugagaaauuugaagacguggagaagaucauucuggacgaagagacaaggaaucuagauaagcaaaagagcgucgggaagcuccugguggaggacaaaaagaaaaagaacaucguuacugcauucuccaaggccaucuuuggauacaaauucaauauugaagaucuucuguugauagagaacgacgaaaagaauaaacucaccuucaacgaugagaacaucgacgauauuuuuaaugaacugucacacaguuuagacgauaagcagauggaccugcucacaaaaacccgggagaucuauuucaaguuuaaacuuaacaugauagugccuacugguuacacacugagcgagucuaugauugaaaaauaugagaugcauaaggcucacuugaaaauguacaaggaguucaucaauacccuaaacacgaaagaucguaagauccugaagaaugccuauuccgacuacauuaacacugagaaagcgaaggcagccaaugcucaggaaaacuuuuacaaaaccgucaagaaaaucauuaaggacaauaacucagauacagccaaaaagauaaucgugcucauugacgagggcaauuucaugccaaagcagcgcacuggggagaacggaguaaucccccaccaacugcaucagaucgaacuugauagaauuauagagaaucaggcaaaauauuacccuuggcuggcugaagccaacccaguugagaagaauaggaaauuugcgaaguauaaauuggacgagcucgugaccuuccggguccccuacuaugugggcccucugaucgauaagacagaaagcaacaagaacgagaaagaaaccaaguuugccuggauggugcgaaaagcaaaggguacgauuacuccauggaauuucgagaacuuagucgaccgcacagaaagugcuaauagauuuaucaaaaggaugaccucuaaggauacuuacauuaucggggaggacguucugccggccuccagccuacucuaugagaaguucaaagugcugaacgaacuuaauaacauaaagguaaaugagaaaaaguuggauaucgaacagaaacaagacauuuaccugaaccucuuuacaaccgcuaagaaugugacgaagaaaucgcuggccaccuaccuuaacugcucugcagauuccaucucaggacugagugacggcgagaaguucaauagcuccuugucuagcuauauugaucucaaagccauccugggcaacauagucgacgacuguaauaagaacgaagauuuagagaaaauuaucgaguacucaacaguguucgaagacgggaauauuuauaaggagaaacugagugaaaucuccuggcuaacugaugagcagauagaaaagcucagcaacauccacuuuaagggauggggucggcugucuaaaaaguugcuuacccagauuacaaacgagaauggcgagcgcaucauugacgcucuguggaacacuucaaauaacuucaugcagaucauaaaugaugaaaguauucaagcgaaacucgcagagaucaacgggaaguacgccggaaaaagcgaccuggaagauaucuuauccgaggcuuauaccucuccccagaauaagaaggccauuagacagguuaugaaaguggucgaggacaucgaaaaggcaaugcaaugcgagccuacaucgauuagcauagaauuuaccaggaaaaagcagaaaucccgucugacuaacacgcgguacaagaagaucucagauguguaugagaaaauugccgacgaaguaaucagugaguacgagcuucgaaaguugcagucugaacucgauagcaaugcuaacaauaugagagacagguacuaucuguacuucaugcagcuaggccgcgauauguauacaggugagaaaauuaacaucgacgaacugcaucaacgguacgacauagaucacauccucccacaguccuuuauuaaggacgauucaaucaauaacagaguucugaccaggaaagacgugaauaacaaggaaaagagcgauaaaacugccgcagaccuuuaugcggucgaaaugucugauuucuggcgcaaguugcgaaaacaggggcugauuaccgagcagaaguacaaaaacuuacucacaaaguccgacaguaucgauaaguaugcuaaaaagggcuuuauaaaacggcaacugguggagaccagccaggucgugaaacuuguugccaauauucugcaggacaaguacucugauacuaagaucaucgaagugcgugcaaaauugaacuccaaucucagagaggaauacaagcugauuaagaacagggccguaaaugacuaucaccaugcuauagacggauaccuaacaacguucaucggccaguaucuguacaaaaccuaucccaagcuccgcucauacuuugucuauaacgauuucaaaaagcuggacaguaauuaccuuaaacacaugaagaaguuuaacuucuuguggcaacugcaggaugacaaaacuauugauaucuacgacaaugugaacaauaaguuuguuuuaaacgugccugagaugaaaaaguauauucagaaaaucuacaauuauaaguacaugcucgucagcaaggaagugacaaccaaaaacggggccuucuaugaucagacaaaguacaaugcaaaaacuguaaaccugauaccaaucaagaaaaauaagcccaccaacauuuauggagguuacaagggcaaagugucguccuacaugaugcuuguuaagauccggaaaaagaaagaggucauuuauaaguucgugggggugccgagacuguggacggacgagcuagauaggcucaaagacaccacagaacgaaagauccuguugaacgagauagcuaaaaauucucugagcaagacugaacaagauuuugaggucauuuuagacaagguuuacuauggacagcucaucaucgauggcaaccagaaauacacccuggguucaagugaguauaaguacaaugccaugcaacuucaucuguccaaacacgcguuggaagugcucgccaaggagaacgugaaggacgcugaaauuacagacaaagaucugguaucugucuaugaggaaauccuaagcgugguuaauaaguacuucgagcuguacgacauaaacaaauuucgccagaaacuuaaugaggggcucgaaauuuuccggaagcugccuguguauaacgucuacgaguccaauaagaucaaacaggugggcaaguuugaaguuuugaacaggauucugaugggauuacaugcaaaugccaugaucacugaucucaaggugcugggcauaaaaaccaaacuugggcagaugcaaguaaacggagguauuaagcugucacccgacgcuaaguugaucuaucagagcccaacgggcaucuucaguagagccguccgugugaaggaucucggguga

SEQ ID NO: 2979 - RNA, 4020 nt, Artificial Sequence
  Cas9 variant
augagccugaacaccaauaagaaauacaacaucggccucgacauugggacaacuuccgugggaugggccgucacggaugcugacggucagaaacuucugaaagcaaagaauaaaaacuuguggggcguuucuuuauucgaggccgggaagaccgcggcugaaagaaggggauaucggucaacacgccgacgucugaaucacagaaaguuuaggcuacggcuccuggaggauauguucgaaaaagagauacuuaguaaggaccccagcuuuuucauccgccugaaagaagccuuuuuguccccuaaggaugagcaaaaacaguucaagggcaacauucucuuuaaugacaaggauuacacugacgcagauuauuacgagcaguauaaaaccaucuaccaucugagauaugaccugauuucucagcacaggcaauucgauauccgggaaguguaccucgccauacaucacuuaaucaaguaccgcggucauuuuauuuaugaggaccagacauucaccacugaugggaaccagcugcagcaccacaucaaagcuauuaucacaaugauaaauucgauucuuaaccgaaucauuaucccagaaaccaucgacauuaauguauuugagaagacguugcuggacagaacuaugaacaggucaagcaaagugaaguuccuaauagagcucaccggagaagauaaacaagacaagccgcugcuuaaggagcuguuuaauuugaucgucggccucaaagcaaagcccgccaguauuuucgaacaggagaaccuggcuacaaucguggaaacuaugaauauguccaccgagcagguucaguuagaucugcucacacuugccgacgugcuggcggaugaggaauacgacuugcuacugaccgcacaaaagauauauucugccauuauccucgaugagagcauggacggcuacgaauauuucgcugaggccaagaaagaauccuaccggaagcaucaggaggagcugguccuugugaagaaaaugcugaagucaaacgcaaucacgaacgaugaacgugcuaaauuugaguauuucuacacugacuacauuggggccaagaguagcaauuaugaagagucuaaaaucauuaagaagggauuguccgcggccuacgguaaauauucaaaggaagaacgccucuuuaaacacauagagcuguuacuggcaaaggaaaacguacuaacaaccguugagcaugaucuccuggaaaagaauaucacuuucgcuagccuuuugccucugcagagaaguucuaggaacgccgugauuccauaccaaguccacgagaaggagcucguggcuauccuggaaaaucaggccacauauuaccccuuucuucuggagcagaaggacaacauccacaaauugcucaccuuccggauuccuuauuacgugggcccacuggcagaccagaaggauuccgaauuugccuggaugguccgaaaacaagcugggaagauaacgcccuucaauuuugaggaaaugguugacaucgaugcgagcucggaggcauucauuaaacgcaugaccaacaagugcacauacuuaauccaugaggacgugauuccuaaacacucuuuuuccuaugccaaguucgaaguacugaaugagcuaaacaagaucagacucgauggaaaaccaauagacaucccgcugaagaaaaggauuuuugaaggccuuuucuuggagaagacuaaagugacccauacaucacugaagaaguggcucgcugaauacgagcacaugacugucagugugguucaggguacccagaaagagacagaguucgccaccagccugcaggcauuucaucgguucgugaagaucuuugaucgcgagacugucuccaaucccgccaacgaagagauguucgagaaaauuaucuauuggucuacgguguuugaagacaagaaaauaaugagaaggaaguuaagcgaguacccucaacugacagaacagcagcagguacaacuugcucagguucguuuccggggguggggacgauugucacagagacucauuaauaggaucaagaccccagugaguggcgaugaggaccacaaacuguccauuaacgaaauccuauggcagacuaaugagaacuuuaugcaaauaauccgcaacaaggauuaucuguucaaaaagauuaucgaggaacaguuugagaaugaaaccgcccuccugaacaaacagcggauugacgagcuugcaacaagccccgcgaauaagaagggcaucuggcaagcuauaaaaauugucaaggaauuggagaaagugcugcagcagccugccgagaacaucuucaucgaauuugcaagaucugaugaggaaucaaagaggaguaccccacgcgacaaauucauugagaaggccuacgcucagcucaaaaaggaaacugacacauuuaauuuagagcaccugaaggagcuuaaacaacgaagcaagcagcuguccucucagcgguuguuccucuauuucauccagaacgggaaauguauguacucgggagaacaucuggauauugagcgucuagacagcuacgaagucgaucacauacugccccaauccuauaucaaggacaauucaauugagaaccucgcccuggugaaaaagguugaaaaucagagaaagaaagauagucuuuugcugaacucuagcaucauuaaucagaacuacuccaggugggagcaguuaaagaaugcaggucucaucggcgagaaaaaguuucgcaaccugacgcggaccaaaauaacugacagagauaaggaaggguucaucgcuaggcaacuuguggagacacgacagauuaccaagcauguaacacagcugcuacaacaggaauauaaagacacuaccaaggucuuugccaucaaagcgacgcucgugucagaucugcgccggaaguucgaguuuauuaaaaauagaaacguuaacgacuaccaccacgcccaggaugcuuucuugguggcauuucugggaaccaauaucacaagcaacuauccgaagauagagauggaauacuuauucaagggcuaucagcauuaccucaaugaggucgguaaaucugccgcuaagccuaaauuuacuuucauuguggaaaaccuguccaagcaacaguacaauaguaccacaggggagguaaaauggaaccccgaaguggacaucgccaaacuuaagaggauccugaauuuuaaacagugcaacauuguucguaaggucgaggagcagagcggcgcauuguucaaagaaacuauauauccaguggaggaaucuuccucaaagaccaucccucucaaaaagcaccuggauacggcgauuuacggaggcuauacagccgugaauuacgcuaguuaugcccuaauccaauucaaaaaggggcgcaagcugaaacgggagauuaucggaauaccccuugcaguccagaccagaaucgacaacagcgaaacuucgcuccagacauacauugcugagcagaucaaguccgagguugaaauucugaaugguaggaucuugaaauaucaacugauaucuaacaauggcaaccgauuauacauugccgggccacgggagcgccauaaugcaagacagcucaucgugagcgacgaagccgcuaaggugaucuggcugauuucaaccaaacaggcgguagaggccacuuuucuuaagcacuacacccuggaacauuuggaggcagucuucgaggaacucaucaggaagcaggcugccgauuaucaaauauuugagaaccugauuaaaaagaucgaagugaacaaagccuacuucuauaguuguacauacaaugagaagguuaaagugauugaggaacuacugaagaucacgcaggcuaacgcaaccaauggagaccuuaagcuccugaaaaugacuaaccgggagggccgauuggguuccgucucuguggccuuagauuuuaagauaauuaaucagagcguuacagggcuguaucaauccaucgaagacuacaacaauuga

SEQ ID NO: 2980 - RNA, 4020 nt, Artificial Sequence
  Cas9 variant
augagccugaacaccaauaagaaauacaacaucggccucgacauugggacaacuuccgugggaugggccgucacggaugcugacggucagaaacuucugaaagcaaagaauaaaaacuuguggggcguuucuuuauucgaggccgggaagaccgcggcugaaagaaggggauaucggucaacacgccgacgucugaaucacagaaaguuuaggcuacggcuccuggaggauauguucgaaaaagagauacuuaguaaggaccccagcuuuuucauccgccugaaagaagccuuuuuguccccuaaggaugagcaaaaacaguucaagggcaacauucucuuuaaugacaaggauuacacugacgcagauuauuacgagcaguauaaaaccaucuaccaucugagauaugaccugauuucucagcacaggcaauucgauauccgggaaguguaccucgccauacaucacuuaaucaaguaccgcggucauuuuauuuaugaggaccagacauucaccacugaugggaaccagcugcagcaccacaucaaagcuauuaucacaaugauaaauucgauucuuaaccgaaucauuaucccagaaaccaucgacauuaauguauuugagaagacguugcuggacagaacuaugaacaggucaagcaaagugaaguuccuaauagagcucaccggagaagauaaacaagacaagccgcugcuuaaggagcuguuuaauuugaucgucggccucaaagcaaagcccgccaguauuuucgaacaggagaaccuggcuacaaucguggaaacuaugaauauguccaccgagcagguucaguuagaucugcucacacuugccgacgugcuggcggaugaggaauacgacuugcuacugaccgcacaaaagauauauucugccauuauccucgaugagagcauggacggcuacgaauauuucgcugaggccaagaaagaauccuaccggaagcaucaggaggagcugguccuugugaagaaaaugcugaagucaaacgcaaucacgaacgaugaacgugcuaaauuugaguauuucuacacugacuacauuggggccaagaguagcaauuaugaagagucuaaaaucauuaagaagggauuguccgcggccuacgguaaauauucaaaggaagaacgccucuuuaaacacauagagcuguuacuggcaaaggaaaacguacuaacaaccguugagcaugaucuccuggaaaagaauaucacuuucgcuagccuuuugccucugcagagaaguucuaggaacgccgugauuccauaccaaguccacgagaaggagcucguggcuauccuggaaaaucaggccacauauuaccccuuucuucuggagcagaaggacaacauccacaaauugcucaccuuccggauuccuuauuacgugggcccacuggcagaccagaaggauuccgaauuugccuggaugguccgaaaacaagcugggaagauaacgcccuucaauuuugaggaaaugguugacaucgaugcgagcucggaggcauucauuaaacgcaugaccaacaagugcacauacuuaauccaugaggacgugauuccuaaacacucuuuuuccuaugccaaguucgaaguacugaaugagcuaaacaagaucagacucgauggaaaaccaauagacaucccgcugaagaaaaggauuuuugaaggccuuuucuuggagaagacuaaagugacccauacaucacugaagaaguggcucgcugaacacgagcauaugacugucagugugguucaggguacccagaaagagacagaguucgccaccagccugcaggcauuucaccgguucgugaagaucuuugaucgcgagacugucuccaaucccgccaacgaagagauguucgagaaaauuaucuacuggucuacgguguuugaagacaagaaaauaaugagaaggaaguuaagcgaguauccucaacugacagaacagcagcagguacaacuugcucagguucguuuccggggguggggacgauugucacagagacucauuaauaggaucaagaccccagugaguggcgaugaggaccacaaacuguccauuaacgaaauccuauggcagacuaaugagaacuuuaugcaaauaauccgcaacaaggauuaccuguucaaaaagauuaucgaggaacaguuugagaaugaaaccgcccuccugaacaaacagcggauugacgagcuugcaacaagccccgcgaauaagaagggcaucuggcaagcuauaaaaauugucaaggaauuggagaaagugcugcagcagccugccgagaacaucuucaucgaauuugcaagaucugaugaggaaucaaagaggaguaccccacgcgacaaauucauugagaaggccuaugcucagcucaaaaaggaaacugacacauuuaauuuagagcaucugaaggagcuuaaacaacgaagcaagcagcuguccucucagcgguuguuccucuacuucauccagaacgggaaauguauguauucgggagaacaccuggauauugagcgucuagacagcuacgaagucgaucauauacugccccaauccuacaucaaggacaauucaauugagaaccucgcccuggugaaaaagguugaaaaucagagaaagaaagauagucuuuugcugaacucuagcaucauuaaucagaacuauuccaggugggagcaguuaaagaaugcaggucucaucggcgagaaaaaguuucgcaaccugacgcggaccaaaauaacugacagagauaaggaaggguucaucgcuaggcaacuuguggagacacgacagauuaccaagcacguaacacagcugcuacaacaggaauacaaagacacuaccaaggucuuugccaucaaagcgacgcucgugucagaucugcgccggaaguucgaguuuauuaaaaauagaaacguuaacgacuaucaccaugcccaggaugcuuucuugguggcauuucugggaaccaauaucacaagcaacuacccgaagauagagauggaauauuuauucaagggcuaccagcacuaucucaaugaggucgguaaaucugccgcuaagccuaaauuuacuuucauuguggaaaaccuguccaagcaacaguacaauaguaccacaggggagguaaaauggaaccccgaaguggacaucgccaaacuuaagaggauccugaauuuuaaacagugcaacauuguucguaaggucgaggagcagagcggcgcauuguucaaagaaacuauauacucuguggaggaauccucaaguaagaccaucccacucaaaaagcaucuggauacggcgauuuauggaggcuacacagccgugaauuaugcuagcuacgcccuaauccaauucaaaaaggggcgcaagcugaaacgggagauuaucggaauaccucuugcaguccagaccagaaucgacaacucggaaacuucccuccagacauauauugcugagcagaucaagucugagguugaaauucugaaugguaggaucuugaaauaccaacugauaagcaacaauggcaaccgauuauauauugccgggccccgggagcgccacaaugcaagacagcucaucgugucagacgaagccgcuaaggugaucuggcugauuaguaccaaacaggcgguagaggccacuuuucuuaagcauuacacccuggaacacuuggaggcagucuucgaggaacucaucaggaagcaggcugccgauuaccaaauauuugagaaccugauuaaaaagaucgaagugaacaaagccuauuucuacuccuguacauauaaugagaagguuaaagugauugaggaacuacugaagaucacgcaggcuaacgcaaccaauggagaccuuaagcuccugaaaaugacuaaccgggagggccgauuggguucugucagcguggccuuagauuuuaagauaauuaaucaguccguuacagggcuguaccaaucaaucgaagacuauaacaauuga

SEQ ID NO: 2981 - RNA, 4020 nt, Artificial Sequence
  Cas9 variant
augaagaaagaguacaccaucggccuggacauugggacaaacagcgugggaugguccguccucacugaugacuauagacuuguuucuaagaaaaugaagguggccgguaauacggaaaaaucaaguaccaagaagaacuucuggggcguaaggcuguuugaugaggggcagacagcugaagcacggcgcagcaaacgaacugcccguagaagguuggcgcggcgcagacaaaggauauuagagcugcagaagaucuucgcucccgaaauucuaaaaaucgacgagcacuuuuucgcccggcucaaugaguccuuucuggugcuugaugaaaagaaacagucucgccauccugucuucgcaaccauuaagcaggagaagucguaccaccaaacauauccaaccaucuaccaucugcgacaggccuuggcugacucaagcgaaaaagcagauauaagacucguguaucuggccauggcucaucugcucaaguacaggggacacuuuuuaaucgagggcgagcugaacacugaaaauaguuccguuacagagaccuuccggcaguuucuuucuacguauaaccagcaauucagcgaagccgacgauaaacagacugagaaguuggacgaagcgguggauugcuccuuugucuucaccgagaaaaugucaaagacuaaaaaggcagagacacugcuaaaguacuuuccgcacgagaaaaguaaugguuaccucagccaguucauuaagcugaugguggggaaccagggaaauuucaaaaacguauuuggccuugaagaagccaagcugcaauucucuaaagagaccuaugaagaggacuuggaggaacuccuggagaagaucggcgaugacuacauugacuuauuuguucaggcuaagaauguguaugaugccguccugcucuccgaaauccuuucagacagcaccaaaaacacacgugcaaagcugagugcugggaugauacgcagauacgaugcccacaaagaggacuuggugcuacugaagagguucgugaaagaaaaucuccccaagaaguaucgggcguuuuucggagauaacucugucaaugguuacgccggcuauauugaggggcaugcaacgcaggaggacuuuuacaaauucguuaagaaagaacugacuggaauccgaggcuccgagguguuucuuacaaagauugaacaagagaacuuccugcgcaaacagagaaccuuugauaacgguguaaucccucaccagauccauuugacugagcucagggcuauuauagccaaucagaagaagcacuacccauuccugaaagaggaacaagaaaaguuagagagccugcuaacauuuaaaauccccuauuacguggggccucucgcuaagaaacaggaaaacucgccauucgccuggcugauucggaagucugaggagaaaaucaagcccuggaaucuuccugaaauagucgacauggagggauccgcagugcgcuucauugaaagaaugaucaacaccgauauguauaugccacacaauaagguuuugccgaaaaacucacugcucuaccagaaguuuaguaucuauaaugagcugacgaaagugagguaccaggacgaacguggccaaaugaacuauuucagcuccauugagaagaaagagaucuuucaugaacuuuucgagaagaaucggaaggucaccaaaaaggaucugcaggaauuuuuguaccucaaauacgacauuaagcacgccgagcugucuggcauagaaaaagccuucaacgcgagcuauacaacuuaccaugacuuuuuaaccaugucagagaauaagcgagagaugaagcaguggcuggaagaucccgagcuagcaaguauguucgaagagaucauuaaaacacucacuguguuugaggacagagaaaugaucaagaccaggcugucccaccaugaggccacacuugggaaacacaucauuaagaaauugaccaagaagcacuauacuggauggggucgccugagcaaagaacucauacagggcauccgggauaagcaaucuaacaaaacgauucuggacuacuuaaucaaugaugacgauuucccucaucacagaaacaggaauuuuaugcagcugauuaacgacgauucacuuaguuucaagaaagagaucaagaaagcucagaugauaacagacaccgaaaacuuggaggagaucguaaaggaacucacugggagcccagccauuaagaaaggaauccugcagucccuaaagauuguugaugagaucgugggcauaauggguuaugaacccgcaaauauugucguggagauggcccgcgaaaaccaaaccacagggcgaggccugaaaucuucgcggccucgucucaaggcucuggaggagagccuuaaagacuuuggaucccaguugcugaaggaauacccaaccgauaauucaaguuuacagaaggacagacucuaucuguacuaccuucaaaacggcagggacauguauacuggggcuccccuggauauccaucgcuugucugacuacgauauugaccacaucauaccgcggagcuucacaacggauaauuccaucgacaacaaaguccucgugucaagcaaggagaauagacugaaaaaggaugacguuccuucugaaaaagugguaaagaagaugagguccuucugguaugaucuauacaguagcaaacugauuucuaagcgaaaacucgacaaccugaccaagaucaaacuuacugaggaagauaaggcaggauuuauuaagcgccaguuggucgagacacggcagaucaccaaacacguggcggguauacugcaucacagauucaauaaggcugaggacacaaacgaacccauuaggaaaguucguaucaucacuuuaaaguccgcccucgugucacaguuucgcaaucgguucggcauuuauaaagucagagagaucaacgaauaccaucacgcacaugaugccuaucugaauggggugguagcucuugcccugcuaaagaaguacccacaacucgcaccugaguuuguguacggagaguaucugaaauucaacgcucacaaggccaauaaagcgaccguuaagaaagaauuuuacaguaacauuaugaaguucuuugagagcgacacgcccgucugugacgaaaacggcgagauauucugggauaaaucgaaguccaucgcccaggugaagaaagugauuaaucaccaucacaugaacaucgucaagaaaaccgaaauucagaaggguggguuuucuaaagagacaguugagccaaagaaggacagcucaaaauugcugcccaggaagaauaacugggauccugcuaaauauggcggauuaggcaguccaaauguggcauacacuguggccuucaccuaugaaaaggggaaagcucgaaagcggacaaacgcccucgagggaaucacuauaauggaacgcgaggcauucgaacaguccccgguacuguuucuuaagaauaaagguuacgagcaagcggagaucgaaaugaagcugcccaaauaugccuuguucgagcucgaaaacggcagaaagaggauggucgcuucuaauaaagaggcccagaaggcaaacagcuuucugcuaccugaacaucuggugacccuucucuaccacgcuaagcaguacgacgagauuucccauaaagagucauucgauuauguuaaugaacaccacaaggaguuuagcgaaguguucgcccggguccuggaguuugcagggaaauacacguuggccgagaagaacaucgaaaaacuggagaagauuuauaaagaaaaucagacagacgauuuagcuaagcucgcgaguucuuucgugaaccugaugcaauuuaaugccaugggagcaccagcugacuucaaguuuuucgauguuaccaucccccgaaaaagauacacuucccuuacagagauauggcagagcaccauuauccaucagucgaucacuggccuguaugaaacccgcauuaggauggguaaguga

SEQ ID NO: 2982 - RNA, 4023 nt, Artificial Sequence
  Cas9 variant
augaagaaagaguacaccaucggccuggacauugggacaaacagcgugggaugguccguccucacugaugacuauagacuuguuucuaagaaaaugaagguggccgguaauacggaaaaaucaaguaccaagaagaacuucuggggcguaaggcuguuugaugaggggcagacagcugaagcacggcgcagcaaacgaacugcccguagaagguuggcgcggcgcagacaaaggauauuagagcugcagaagaucuucgcucccgaaauucuaaaaaucgacgagcacuuuuucgcccggcucaaugaguccuuucuggugcuugaugaaaagaaacagucucgccauccugucuucgcaaccauuaagcaggagaagucguaccaccaaacauauccaaccaucuaccaucugcgacaggccuuggcugacucaagcgaaaaagcagauauaagacucguguaucuggccauggcucaucugcucaaguacaggggacacuuuuuaaucgagggcgagcugaacacugaaaauaguuccguuacagagaccuuccggcaguuucuuucuacguauaaccagcaauucagcgaagccgacgauaaacagacugagaaguuggacgaagcgguggauugcuccuuugucuucaccgagaaaaugucaaagacuaaaaaggcagagacacugcuaaaguacuuuccgcacgagaaaaguaaugguuaccucagccaguucauuaagcugaugguggggaaccagggaaauuucaaaaacguauuuggccuugaagaagaggccaagcugcaauucucuaaagaaaccuaugaggaggacuuggaggaacuccuggaaaagaucggcgaugacuacauugacuuauuuguucaggcuaagaauguguaugaugccguccugcucuccgagauccuuucagacagcaccaaaaacacacgugcaaagcugagugcugggaugauacgcagauacgaugcccacaaagaagacuuggugcuacugaagagguucgugaaagagaaucuccccaagaaguaucgggcguuuuucggagauaacucugucaaugguuacgccggcuauauugaggggcaugcaacgcaggaagacuuuuacaaauucguuaagaaagagcugacuggaauccgaggcuccgaaguguuucuuacaaagauugagcaagagaacuuccugcgcaaacagagaaccuuugauaacgguguaaucccucaccagauccauuugacugaacucagggcuauuauagccaaucagaagaagcacuacccauuccugaaagaggaacaagagaaguuagaaagccugcuaacauuuaaaauccccuauuacguggggccucucgcuaagaaacaggagaacucgccauucgccuggcugauucggaagucugaggagaaaaucaagcccuggaaucuuccugaaauagucgacauggaaggauccgcagugcgcuucauugagagaaugaucaacaccgauauguauaugccacacaauaagguuuugccgaaaaacucacugcucuaccagaaguuuaguaucuauaaugaacugacgaaagugagguaccaggacgagcguggccaaaugaacuauuucagcuccauugagaagaaagaaaucuuucaugagcuuuucgaaaagaaucggaaggucaccaaaaaggaucugcaggaguuuuuguaccucaaauacgacauuaagcacgccgaacugucuggcauagagaaagccuucaacgcgagcuauacaacuuaccaugacuuuuuaaccaugucagagaauaagcgagaaaugaagcaguggcuggaggaucccgaacuagcaaguauguucgaggagaucauuaaaacacucacuguguuugaagacagagagaugaucaagaccaggcugucccaccaugaagccacacuugggaaacacaucauuaagaaauugaccaagaagcacuauacuggauggggucgccugagcaaagagcucauacagggcauccgggauaagcaaucuaacaaaacgauucuggacuacuuaaucaaugaugacgauuucccucaucacagaaacaggaauuuuaugcagcugauuaacgacgauucacuuaguuucaagaaagaaaucaagaaagcucagaugauaacagacaccgagaacuuggaggaaaucguaaaggagcucacugggagcccagccauuaagaaaggaauccugcagucccuaaagauuguugaugaaaucgugggcauaauggguuaugagcccgcaaauauugucguggaaauggcccgcgagaaccaaaccacagggcgaggccugaaaucuucgcggccucgucucaaggcucuggaggaaagccuuaaagacuuuggaucccaguugcugaaggaguacccaaccgauaauucaaguuuacagaaggacagacucuaucuguacuaccuucaaaacggcagggacauguauacuggggcuccccuggauauccaucgcuugucugacuacgauauugaccacaucauaccgcggagcuucacaacggauaauuccaucgacaacaaaguccucgugucaagcaaggaaaauagacugaaaaaggaugacguuccuucugagaaagugguaaagaagaugagguccuucugguaugaucuauacaguagcaaacugauuucuaagcgaaaacucgacaaccugaccaagaucaaacuuacugaagaggauaaggcaggauuuauuaagcgccaguuggucgagacacggcagaucaccaaacacguggcggguauacugcaucacagauucaauaaggcugaagacacaaacgagcccauuaggaaaguucguaucaucacuuuaaaguccgcccucgugucacaguuucgcaaucgguucggcauuuauaaagucagagaaaucaacgaguaccaucacgcacaugaugccuaucugaauggggugguagcucuugcccugcuaaagaaguacccacaacucgcaccugaguuuguguacggagaauaucugaaauucaacgcucacaaggccaauaaagcgaccguuaagaaagaguuuuacaguaacauuaugaaguucuuugaaagcgacacgcccgucugugacgagaacggcgaaauauucugggauaaaucgaaguccaucgcccaggugaagaaagugauuaaucaccaucacaugaacaucgucaagaaaaccgagauucagaaggguggguuuucuaaagagacaguugaaccaaagaaggacagcucaaaauugcugcccaggaagaauaacugggauccugcuaaauauggcggauuaggcaguccaaauguggcauacacuguggccuucaccuaugagaaggggaaagcucgaaagcggacaaacgcccucgaaggaaucacuauaauggagcgcgaagcauucgagcaguccccgguacuguuucuuaagaauaaagguuacgagcaagcggaaaucgagaugaagcugcccaaauaugccuuguucgaacucgagaacggcagaaagaggauggucgcuucuaauaaagaagcccagaaggcaaacagcuuucugcuaccugagcaucuggugacccuucucuaccacgcuaagcaguacgacgagauuucccauaaagaaucauucgauuauguuaaugagcaccacaaggaauuuagcgagguguucgcccggguccuggaguuugcagggaaauacacguuggccgaaaagaacaucgagaaacuggaaaagauuuauaaagagaaucagacagacgauuuagcuaagcucgcgaguucuuucgugaaccugaugcaauuuaaugccaugggagcaccagcugacuucaaguuuuucgauguuaccaucccccgaaaaagauacacuucccuuacagaaauauggcagagcaccauuauccaucagucgaucacuggccuguaugagacccgcauuaggauggguaaguga

SEQ ID NO: 2983 - RNA, 4023 nt, Artificial Sequence
  Cas9 variant
augaagaccgacuacuucaugggccuggauauggggacaggaagccucgguugggccgugacugacuccucuuaucaccuuugcagagcucauggcaaagaucuguggggagucagguuguuugagacggcacagaccgccgaagaacggcgcguuuuccgauguaaccguagaagguuagaccggcgcaagagaaggauccaacugcuacaggauauuuuugcgcccgaaauauacaaaaucgacccuggguucuuucuccggcugaaggagucacgcuaucuuccagaagauaaaaagaaucuggagggcaagacaccggaguugcccuacgcucucuucguggacaaaaaguauacugauaaagacuuucacaaggaauacccuaccauuuaucaucugcgacugagacucaugcaggauaggacaccagccgacguacgguuaguguaccuggcacuucaccauuugaucaaacaccguggucacuuccuguuugccgggauugaggcugauaaggucaccgacuucagugcagccuuuagcgaguuccuacgcaucgugcaggagcaagagcucgacauauccuuuacucccgaugaagagucuucgcagaucauuaaggaaacacugcagaacaccaauuucacgagaagcaaaaagucaacugagcuuaucaaaggacugaaggcuaguaccggcugcgaaaaagccuugcucaagcugauuuccggcuguaaaguuaaguuaucugcgguguucgacgauccugggugcgacgcauacgagaagccacaggucuguuuugccgagagcuccuaugaagauuacgcugccauccuggaggacgaacucgaggauagguucauagugauugcagcugccaaagcgcuuuaugacuggucaguacugguuaacaucuugggagaagccaguacagugagcgaggcaaaggucgguauuuacgagaaacaucggcgagaucuaaaguaucugaaacaccucgugaagacuaaucugacccgcgaagacuaccaagaucuuuuugugaaggcuggcgccaaaaagaacaauuauugcgcuuacaucgggaugaccaaaaagaacaauaaaaaggucguucuggaggaaaagagauguacaaaagaggacuucuacgccuauuugaagaaagaaaucuacucuaaggugcaggagaaccccgaggcagaauaucuccuggaggaauuagagaaaggaacguuucugccuaggcagguauccaaggacaauggcgugauuccauaccagcuacaauuccucgagcugcagaagauacuuaaaaacgccgucgaauauuugccguuucugaaggaggaaucagagaaaauccagcaaauuaugacuuuccggauccccuacuauguggguccucucaaugggaagaaagaaggacagaacacauuugcuugggcgguucgcaagaauaacgagccaguguaccccuggaacuucgaggaagucauagauaccgaggcaagcgccgaacaguuuauuagaaggaugacuaauaaaugcacauaccugccuggcgaggacgugcuuccaaaggaaagucuguuguauucuaaguucaugguacucaacgagcugaauaacuuacguaucaauggcaccaaaaucuccguugagcugaagcaggaacuauacgagaaacucuuucaacgguaucgaaaggugagcgcuaaaaagcugagagauuaccuugucaggaacgggauuacggaaaaggacgccgagaucucgggaauugauggugacuucaaaggcaccuugcgcgcauaucaugauuucaaggaaaaacugacagggguggagcucacugaggccgaaaaggagaccauaauccugaauauuacauuauuuggagaagacaaaguccugcuuaagaagcggaugcagagauugcuccccaaccugacugagggccagaaaaaggcuaucgugacccuaaauuacucugguugggggaggcugucccgcgaguuccucgaagagguucaggccccgaacccugaaucaggcgagauccugaguauuauacgagcacuuugggaaacaaaugcgaacuugaugcaacuguuaagcaaucaguauggauaccaggagauccucgagcagaugcgggcugauuggaccggccacaaacuggacuaccaaacuguggaagaacuuuauguaucccccgccgucaagcgucagauuuggcagacgcugcaagugguuaaagaauugaagaaggugaugggaggggagccaaaaagagucuuucucgaaguggcaagggagaagauggagucuggucgcacaguaagccggaaaaagcaccugaaagaucuauaccugucauguaagagugaagagagaaacuggcucgccgaacuggacaggcaugaggaacacuccuaucgaagcgaucgccuuuucuuguacuauacccagaaaggccggugcauguacugugggaagccuaucgaccugggacauuuaugggacgugaauauguaugauauugaccacaucuacccccagucuaagguuauggaugacucaauaagaaacaggguccucacuugccguaccugcaacgcugagaaaacagaucauuacccacugaaggccgagauccgccagaaaaugcggcccuuuugggacagucuuaaggcaggcaauuucauugaagaggaaaaauggaagagacugaucaggagcgaggaguuuaccuccacugaacuagcugguuucauugagcgacaacucguggaaacacggcagucuacgaaggccguggcggauauccugaaacaggccaugccugagaccgaaauagucuauguuaaggcuaaaaacgugucggcauuucgccaggacuucaauuuugugaagaacagagauguaaaugacuuccaccacgccaaagaugcuuacuugaacauugucguggggaauacuuauuuuguuaaguucacaaagaacgccagcugguucaucgagaggaauccaggccgguccuacaaccugaaacgaauguuuaccucagacuaugaugugaugaguaauggagagauugcauggaaggcgggcaacucugggacaaucacuaccgucagaaaaaugaugaagaaaaauagcguguuauucacgcgcagguccuuugaaguuucaggaggucucuucgaccaacagcugaugaagaagggcaaaggacagguguacguaaagagcggggacgagcgucuucggucuauagaaaaauauggcgguuacaacaaggccaccggggcuuacuuuaugcuggucgaguccgaaggcaaaaagggagugaagaaaagaacaaucgaguucgugccguuguauaggaaggccgagcucgaagcaagugaggagaaaaugcuggaguaccuacgcacugaaauuggccugaaggagccccauguccuucuccacaaaaucaagaccgauacacuguuucaggcugacggguucaaaaugcauuugagcggacgaacuggcaagcaacugguuuuuaagggugccaaucaguucuuaguggcagaggauuaugaaagacuccugaaaaagguagggaaagugaccgagcagcuuaagacgaacaaaaacuacaagauuaaugacuaugauggaaucacagaagagggccugaaggccuuguacucugaguuucucuccaaacugcagaaggcuccuuaugguaaccggcuaggcacccaagcggaaacucuggagaaugggaaagaaaaguucgacaaacuuucacucgagaacaagugucagguccugagugaaauauugcacuuauuccagugcaauagcucggccgcagaucuguccaagcucggaggcccagggcacggaggcauucuggugcuuucuaacgagaucacaaaauguaauaagaucagcauuauccaucaaucacccgcugguauuuacgagcaggaaauagaccugaaaaccuuguga

SEQ ID NO: 2984 - RNA, 4023 nt, Artificial Sequence
  Cas9 variant
auggagcaggaauacuaucugggccucgacauggggaccggaagcguggguugggccgucacagauuccgaguaccacguucuuagaaagcauggcaaagcucuguggggagugagguuguucgaaucugcaucaacugccgaggaacggcgcauguuucgaacgagucguagaagguuagaccggcgcaacuggagaaucgagauucugcaagagauauucgcggaagagaucagcaagaaagaucccggguuuuuccuaaggaugaaggaauccaaauauuacccugaggacaagcgggauauuaauggcaacugcccagagcucccguaugcucuguuuguagacgaugacuucaccgauaaggacuaccacaaaaaguuucccacaaucuaucaucuucgcaaaaugcugaugaauacugaagagaccccugauauucgauugguguaccucgccauccaccauaugaugaagcacagaggucacuuccugcugucuggggacauaaacgaaaucaaagaguuuggaacaaccuucucgaagcucuuagaaaauauuaagaacgaggagcuggauuggaaucuugaauugggcaaagaggaauacgcagucguggagucaauccugaaggacaacaugcuaaauaggagcacuaaaaagacacggcucauuaaagcccugaaggcuaaaaguaucugugaaaaggcaguucuuaaccuguuggccggcgggaccgugaagcucuccgacauauuuggacuggaggaguuaaaugaaacggagcguccaaaaauuucuuucgcugauaacgguuaugacgauuacaucggcgaagucgagaaugaacugggggagcaguuuuauauuaucgagacugccaaggcgguguacgacugggcaguacucguugaaauccuuggaaaauauaccagcauuuccgaggccaagguggcuacauacgaaaaacauaagucagaucugcaguucuugaagaaaauaguccgcaaguaucuaacuaaagaggaguacaaggacaucuucgugaguaccagcgauaaacugaagaacuacucugccuauauuggcaugacaaagaucaaugguaaaaagguggaccuccaguccaaaagaugcucaaaggaagaguuuuacgauuucauuaaaaagaacguccugaagaaacuugaagggcaacccgaguaugaauaccugaaggaggaguuggaaagggagaccuuucucccuaaacagguuaaccgggacaauggagugauaccauaucagauccaccuguacgaauuaaagaaaauccugggcaaccuacgagauaagauugaccucaucaaagagaaugaagacaagcugguacagcuuuucgaguuucgcauucccuauuacgugggcccuuugaacaagauagaugacgggaaagagggaaaguucacgugggcagucagaaaaagcaaugaaaagaucuacccauggaacuuugagaaugugguugauauugaagcuagugccgagaaauucaucaggcggaugacuaacaaguguacauaucugaugggugaagacgugcucccgaaggauucucugcuuuacuccaaauauaugguccugaaugaguugaacaaugugaagcucgacggcgagaaacugagcguagaauuaaagcaacgccuguacaccgauguguuuugcaaauauagaaagguuacugucaagaaaaucaagaacuaccuaaaaugugaggggauuauaucgggaaauguggaaaucacaggcauugacggugauuucaaggcgucucucaccgccuaucaugacuuuaaagagauccugacggggaccgagcuugcaaagaaggauaaagaaaacauuaucacaaauauagucuuguucggcgacgauaagaaacugcucaagaaaaggcugaaccguuuauacccccagaucacuccuaaccagcugaagaaaauuugcgcucuuuccuacaccggauggggccgguuuucaaagaaguucuuggaggaaaucacagccccagaccccgagacuggggaaguguggaauauuaucaccgcucucugggagaguaacaauaaccugaugcagcuacugagcaaugaguaucgauucauggaagagguugaaacauacaacaugggaaaacaaaccaagacucucuccuaugagacgguggaaaauauguacguaucuccuagcgucaaaagacagauauggcagacacugaagauugugaaagagcuugagaagguuaugaaggaaucaccaaaaaggguguuuaucgagauggcccgcgaaaagcaagagaguaaacggaccgaauccagaaagaaacaguugauugaccuguauaaggcauguaagaacgaggagaaagauugggucaaggaauuaggugaccaggaggaacagaaacucaggagcgauaagcuguaccuuuauuacacucaaaaaggccgcugcauguacucuggggaggugaucgagcugaaggacuugugggauaauaccaaguaugacauagaucacaucuacccccagucaaaaacaauggacgauagucucaacaaucgaguacuggugaagaaaaaguauaacgccaccaaaagcgacaaguacccgcuaaaugaaaacauucggcacgagcguaagggauucuggaaaucccugcucgauggcgguuuuaucucuaaggaaaaauaugagagacugauuaggaauacugaacuuucgccugaggaguuggcuggguucaucgaacgccagauaguugagacacggcagagcacgaaggcggucgcagaaauucugaaacaaguguuucccgaguccgaaaucguguacgucaaggccggcaccguuucaagauucaggaaagacuuugaguuacucaaggugcgagaggugaacgaucugcaucacgcuaaggacgccuaucuuaacaucguagucggaaauaguuacuacgugaaauucacuaagaacgcaucuugguuuauuaaagaaaauccaggccgcacauauaaccugaagaaaauguucaccagcggguggaauaucgagcggaacggagaaguugccugggagguggguaagaagggcacaauugucacugugaaacagauaaugaauaagaacaauauccuaguuaccagacaggugcaugaagcuaaagggggacucuuugaccagcaaauuaugaagaaaggcaagggucagaucgccauuaaggagacggaugagaggcuggcauccaucgaaaaauacgggggcuauaacaaggcggcuggagccuacuucauguugguagagucaaaagacaagaaaggcaagaccauacguacaaucgaauuuauuccucuguauuuaaagaauaaaaucgagagcgaugagucuauugcacucaacuuccuggaaaaggggcgcggacuuaaagagcccaagauccuguugaaaaagauaaaaauugacacucucuucgaugucgacggcuuuaagauguggcuguccggucggaccggggauagacuacuguucaagugugccaaucagcuuauccucgacgagaaaaucauugugacaaugaagaaaauagugaaguuuauccagaggcgacaagaaaaccgggaacugaaauugagugauaaggacggaauugauaaugagguccugauggagaucuacaacacuuucguugacaaguuagaaaacaccguguaucgcauuagacucagcgagcaggcuaaaacgcugaucgacaagcagaaagaauuugagaggcuuucucuggaagauaaguccucaacauuguucgagauacuccacaucuuucaaugccagaguagcgccgcaaaucugaaaaugauuggcgguccaggcaaggcugggauccuaguaaugaacaauaacauuucgaaguguaauaaaaucuccauaauuaaccagucucccaccggaaucuucgagaaugaaaucgaccugcuuaagauuuga

SEQ ID NO: 2985 - RNA, 4023 nt, Artificial Sequence
  Cas9 variant
augggcgaggaauacuuccuggggcucgacaugggaaccgguagccuuggcugggccgugacagaugacaaguaucagauccugagaaggcacgggaacgcuuuguggggaguccgguuauuugagacugcaaauacggccgaagaacgccgaauguuccguaccaacagaaggcggcuggaucgccaaggcuggagaauuaaaauacuacaggaacucuuugcggaggagaucugcaggguugaccccgguuucuaccugcggaugaaggaauccaaauauuacccugaggauaagcgcgacgcuaauggggaauguccagcccuuccguaugcacuguuugccgaugcucaguacacagacaaagauuaucaucgagaguuccccacuauuuaccacuugagaaagaugcucauggagaccgaaacaaccccugacaucaggcugguguaccuggcauuucaucacaugaugaagcaucggggacacuuccucuuaucuggcgauauuucacagguaacugaguuucguaacacauuccugcaaaugaucgccaauauaaaaagugaagaacuugacuuuagcuuggaaaucgaggagacccagaugggccagauugaagcugugcugaaggaucacaaacuaacgcgcuccgagaagaaaagaaggcucacucagauccugaagccagccaccgcgugcgaaaaggcaauuuucacacuucugucugggggaacugucaaauugucggacaucuuugguaaggccgagcucgacgaaggcgagcggcccaaaauaucauucgcugauaacggguaugacgauuacagcgccaguguggaggcagaccugggagaacaauauuacauuaucgaguccgcuaaggccguuuaugauuggucuguguuaagcgacauucugggcgauuccgucucaaucagugacgcgaaagugaagcucuacgaaaaacauaagaaggaucuugccuaucugaaaaagguaguucgagagaauuugccucgcgaaguguacaaccaggucuucgugaauaccgacgagaaacuauguaacuacugcgcauauaucgguauggcuaagaaaaaugggagaaagguggcccuggagggaaagagguguacacgggaagaguuugagagcuuccuccgcaaaaagauugucaacaaaauagaggauaaggagauccaggaauaccugucugaggaaauugagaaaggcaccuuucuuccaagacagguuacgaaggacaauggcgugauccccuaucaaauacaccuguacgaauugaggaagauuaucgacaaccucuccccucguaugccauucauccgggauaauggggacaaaauuauccagcuguuuacuuuccgaauaccguauuacguaggacccuuagguaagggcgaggggucagagaaauuuagcugggcugugagaaggacagaugaagccauuuauccuuggaacuucaaggacgucaucgauguggaggcaagugccgaaaaauuuauuugccgcaugaccaacaaguguacuuaccuguacggagaggacguucuaccaaaggauucuccccucuauuccaaauucauggugcugaaugaacuuaacaauuugaagcuggacggccagagcgucucgguggagcucaaacaacggaucuaccaggagcuguuuugccauacaagaaagguaacccagaaaaagcugguuucuuaucuugugagggaagguaucacggggaaaaacgucgagauuuccggcauagauggagacuucaaggcuucauugaccgcguaccacgauuuuaaggaaaaacucacaggcguggagcugagucagcaagaacaggaggagaucguccgcaauauuguguuauucggggaagacaagaaacugcuaaagcagcgacucgagggacgguucccucagcugacucaaaaacagaucagcguuauugcaacccuuuccuauaaggguuggggccguuugucuagagaauuucuggagaacaucacagugccagcccccgggacuggagagguauggaauauaaucaccgcucucugggaaacaaacgauaaucugaugcaguuacuguacggcgaguaugguuuccagaccgaaauugaguguuuuaacgccaaggagaaaaagaaaagccuuucauacgagacuaucgaggaaaguuacgucuccccgagcgugaagaggcaaauuuggcagacguugcagguugugaaagagcucaagaaggucaugcgcggggacccuaaacggguguucaucgaaauggcaagagagaaucaggaaucuaagaggacagagucacgaaagaagacccugcuagaccuguauaaaaacugcaagaaggaggaacccgaguggauagccgaacucacugagcaccuggaaaaacuugaugacagucaauugcgcaaggauaaacuguuuuuauacuauacccagaagggccgguguauguacagcggagagagaauugagcucgaagaccugugggauaauacaagguaugacaucgaucauauuuacccacaguccaaaaccauggacgauucuguagacaaccgugugcuuguuaagaaagaguauaaugcuaagaagacugaugucuacccuaucgccgcagacauacgcggcaaaaugucgcccuucuggaagaaacuguuggauaacaagcucaucagcaaaaagaaguacgaccggcuggugagaacagaagaacuaacgccagaggaacuggcgggguuuauugacaggcaacucguggagacccgacaguccacuaaagucguugcugaaauccugaaggaggccuuccccgauacagaaauuguguaugugaaagcaggaaacguaucaaauuuucggcacauguucgacaucgucaaggugcgcgagcuuaacgauuugcaucacgccaaagacgcuuaccugaauauaguuguggguaacgccuauuacgucaaguuuaauaagaacgcagcuugguucauuaaagagaauccuggcagaaguuauaacuuaaagaggauguuugauuacgacauccggcgaaauaacgaaguggccuggcucgcggggucuaccggaacaaucagccagguuaaaaauaugguguccaagaaccauauucugguaacuagaaaaucauaugaggucaccggcggucuuuucgaucagcaacugaugaagaaggggaaaggccaggugccagugaagacgagcgacgaacgccuaggaaauaucgagaaauacggcggguacaacaaggccucuggagcuuauuucaugcucgucaaauccaagaauaagaaaggcgaggagcagaggaccauugaguacguuccgauauaucugaagcacuacaucgaagagaguaaagaaaacgcauuggauuaucugaagaacgagcguaaauuaaaugaacccgagauucuccuggacaagaucaaaaaggauacacuuuuucgggugaacgguuucuacaugugccugagcaagagaacugggaaacaguuggccuuuaagggagcuaaugagcuccugcuaccugaaccagagacccugcuucucaaaaagauuacaaaauauauccaaaggcgcaaggaaaacaaggaccugaaauugacuaagcaggacaauauaaccgagaaagagcuguuagaacucuacgauguauucacggagaagcugaaccacucuguguacgccgucugccuuggcacacaggguaaaacccuggugcagaagaagcccgcauuuguugcguugccuguggaagagaaauguaucguccucuccgaaauucugcaucuauuccaaugccagucaggcagugccaaucugaaacuuaucgggggaccagcuagcgccggcauucucuaucugaacucgaauaucuccgacgcaggggagauauugauuaucaaccagucucccagcggaaucuuugagaaacgaauugauuuacugagacucuga

SEQ ID NO: 2986 - RNA, 4023 nt, Artificial Sequence
  Cas9 variant
augaagaaagaguacaccaucggccuggacauugggacaaacagcgugggaugguccguccucacugaugacuauagacuuguuucuaagaaaaugaagguggccgguaauacggaaaaaucaaguaccaagaagaacuucuggggcguaaggcuguuugaugaggggcagacagcugaagcacggcgcagcaaacgaacugcccguagaagguuggcgcggcgcagacaaaggauauuagagcugcagaagaucuucgcucccgaaauucuaaaaaucgacgagcacuuuuucgcccggcucaaugaguccuuucuggugccugaugaaaagaaacagucucgccauccagucuucgcaaccauuaagcaggagaagucguaccaccaaacauauccgaccaucuaccaucuucgacaggcccuggcugacucaagcgaaaaagcagauauaagauugguguaucucgccauggcucaucugcugaaguacaggggacacuuucucaucgagggcgaguuaaacacugaaaauaguuccguuacagagaccuuccggcaguuucugucuacguauaaccagcaauucagcgaagccggugacaaacagacugagaaacuugaugaagcgguggacugcuccuuugucuucaccgagaaaaugucaaagacaaagaaggcagagacuuugcugaaguacuuuccccacgaaaagaguaauggguaccuaagccaguucauuaagcucauggugggaaaccagggcaauuucaaaaacguauuuggccuggaggaagaggccaaacuucaauucucuaaagaaaccuaugaggaggaucuggaagaguugcucgaaaagaucggggacgauuacauugaccuguuuguucaggcuaagaauguguaugacgccgucuuacuguccgagauccucucagauagcacaaagaacacccgugcaaaacuuagugcuggaaugauacgcagauacgacgcccacaaagaagaucugguguugcuaaagagguucgugaaagagaaucugccuaagaaguaucgggcguuuuucggugacaacucugucaauggcuacgccggguauauugagggacaugcaacgcaggaggcuuuuuacaaauucguuaagaaagaacucacuggcauccgagguuccgaaguguuucugacaaagauugagcaagagaacuuccuucgcaaacagagaaccuuugauaacgggguaaucccacaccagauccaucugagcgaauugagggccauuauagcuaaucagaagaagcacuaccccuuccucaaagaggaacaagagaagcuggaaucguuacugacuuuuaaaaucccuuauuacgugggaccacuagccaagaaacaggagaacucucccuucgcauggcucauucggaaguccgaggaaaagaucaagccuuggaaucugccagagauagucgacauggaaggcucagccgugcgcuucauugagagaaugaucaacacagauauguauaugccgcacaauaagguucuucccaaaaacaguuugcuguaccagaaguuuagcaucuauaaugaacucaccaaagugagguaccaggacgagcguggccaaaugaacuauuucuccucuauugagaagaaagaaaucuuucaugagcuguucgaaaagaaucggaaggucacgaaaaaggaucuucaggaguuucuguacuugaaauacgacauuaagcacgcugaacucagcgggauagagaaagcguucaacgcaucauauaccacauaccaugauuuucugacuaugagugagaauaagcgagaaaugaagcagugguuagaggacccugaacuggccuccauguucgaggagaucauuaaaacccuaacaguguuugaagacagagagaugaucaagacuaggcucagccaccaugaagcuacccugggaaaacacaucauuaagaaacuuacaaagaagcacuauaccgguuggggccgcuugucuaaagagcugauacaggggauccgggauaagcaaucaaacaaaacuauucucgacuaccugaucaaugaugacgauuucccacaucacagaaacaggaauuuuaugcaguuaauuaacgacgauagucugagcuucaagaaagaaaucaagaaagcccagaugauaacggacacagagaaccuugaggaaaucguaaaggaguugaccggaucccccgcaauuaagaaaggcauccuccagucucugaagauuguugaugaaaucguggguauaaugggguaugagccugccaauauugucguggaaauggcucgcgagaaccaaacuaccggccgaggacuaaaaucgagccggccacgucugaaggcccucgaggaaucccugaaagacuuuggcucacagcuuuugaaggaguaccccacagauaauaguucucugcagaaggacagauuauaucucuacuaccugcaaaacgggagggauauguauaccggagcaccgcuugacauccaucgccugagcgacuacgauauugaccacaucauaccucgguccuucacuacagauaauucaaucgacaacaaagucuuggugagcucuaaggaaaauagacucaaaaaggaugacguucccuccgagaaagugguaaagaagaugaggaguuucugguaugaucuguacagcucuaaacuaauuuccaagcgaaaacuggacaaccucacgaagaucaaacugaccgaagaggauaaggcggguuuuauuaagcgccagcuugucgagacucggcagaucacaaaacacguggcuggcauauugcaucacagauucaauaaggccgaagacaccaacgauccaauuaggaaaguucguaucaucacacugaagucagcauuagugagucaguuucgcaaucgguucgggauuuauaaagucagagagaucaacgaauaccaucacgcccaugacgcuuaucucaauggagugguagcccuggcacuucugaagaaguacccucaacuagcucccgaguuuguguacggcgaguaucucaaauucaacgcccacaaggcgaauaaagccacuguuaagaaagaauuuuacagcaacauuaugaaguucuuugagucggauaccccagucugugacgaaaacggugagauauucugggacaaauccaagucuaucgcucaggugaagaaagugauuaaucaccaucacaugaacaucgucaagaaaacggaaauucagaaagggggcuuuagcaaagagaccguugagcccaagaaggauucaaguaaacuguugccuaggaagaauaacugggacccagcaaaauauggaggccugggguccccgaauguggccuacacaguggcuuucacuuaugaaaagggaaaagcccgaaagcggaccaacgcauuagaggguaucacaauaauggaacgcgaggcguucgaacagucucccguacucuuucugaagaauaaaggcuacgagcaagccgagaucgaaaugaaacuuccuaaguaugcucuguucgaguuggaaaacgggagaaagaggauggucgccagcaauaaagaggcacagaaggcuaacuccuuucuccugccagaacaucuagugacucugcuuuaccacgccaagcaguacgaugagauuucacauaaagagagcuucgacuauguuaaugaacaccacaaggaguuuagugaaguguucgcacggguccucgaguuugccggaaaauacacccuggcugagaagaacaucgaaaaauuggagaagauuuauaaagaaaaucagacggaugaccuggcgaaguuagccucuuccuucgugaaccucaugcaauuuaaugcaaugggcgcucccgccgauuucaaguuuuucgacguuacaaucccucgaaaaagauacaccagccugacugagauauggcagucgacaauuauccaucagucaaucaccggucuuuaugaaacucgcauuaggauggggaaguga

SEQ ID NO: 2987 - RNA, 4023 nt, Artificial Sequence
  Cas9 variant
auggagcaggaauacuaucugggccucgacauggggaccggaagcguggguugggccgucacagauuccgaguaccacguucuuagaaagcauggcaaagcucuguggggagugagguuguucgaaucugcaucaacugccgaggaacggcgcauguuucgaacgagucguagaagguuagaccggcgcaacuggagaaucgagauucugcaagagauauucgcggaagagaucagcaagaaagaucccggguuuuuccuaaggaugaaggaauccaaauauuacccugaggacaagcgggauauuaauggcaacugcccagagcucccguaugcucuguuuguagacgaugacuucaccgauaaggacuaccacaaaaaguuucccacaaucuaucaucuucgcaaaaugcugaugaauacugaagagaccccugauauucgauugguguaccucgccauccaccauaugaugaagcacagaggucacuuccugcugucuggggacauaaacgaaaucaaagaguuuggaacaaccuucucgaagcucuuagaaaauauuaagaacgaggagcuggauuggaaucuugaauugggcaaagaggaauacgcagucguggagucaauccugaaggacaacaugcuaaauaggagcacuaaaaagacacggcucauuaaagcccugaaggcuaaaaguaucugugaaaaggcaguucuuaaccuguuggccggcgggaccgugaagcucuccgacauauuuggacuggaggaguuaaaugaaacggagcguccaaaaauuucuuucgcugauaacgguuaugacgauuacaucggcgaagucgagaaugaacugggggagcaguuuuauauuaucgagacugccaaggcgguguacgacugggcaguacucguugaaauccuuggaaaauauaccagcauuuccgaggccaagguggcuacauacgaaaaacauaagucagaucugcaguucuugaagaaaauaguccgcaaguaucuaacuaaagaggaguacaaggacaucuucgugaguaccagcgauaaacugaagaacuacucugccuauauuggcaugacaaagaucaaugguaaaaagguggaccuccaguccaaaagaugcucaaaggaagaguuuuacgauuucauuaaaaagaacguccugaagaaacuugaagggcaacccgaguaugaauaccugaaggaggaguuggaaagggagaccuuucucccuaaacagguuaaccgggacaauggagugauaccauaucagauccaccuguacgaauuaaagaaaauccugggcaaccuacgagauaagauugaccucaucaaagagaaugaagacaagcugguacagcuuuucgaguuucgcauucccuauuacgugggcccuuugaacaagauagaugacgggaaagagggaaaguucacgugggcagucagaaaaagcaaugaaaagaucuacccauggaacuuugagaaugugguugauauugaagcuagugccgagaaauucaucaggcggaugacuaacaaguguacauaucugaugggugaagacgugcucccgaaggauucucugcuuuacuccaaauauaugguccugaaugaguugaacaaugugaagcucgacggcgagaaacugagcguagaauuaaagcaacgccuguacaccgauguguuuugcaaauauagaaagguuacugucaagaaaaucaagaacuaccuaaaaugugaggggauuauaucgggaaauguggaaaucacaggcauugacggugauuucaaggcgucucucaccgccuaucaugacuuuaaagagauccugacggggaccgagcuugcaaagaaggauaaagaaaacauuaucacaaauauagucuuguucggcgacgauaagaaacugcucaagaaaaggcugaaccguuuauacccccagaucacuccuaaccagcugaagaaaauuugcgcucuuuccuacaccggauggggccgguuuucaaagaaguucuuggaggaaaucacagccccagaccccgagacuggggaaguguggaauauuaucaccgcucucugggagaguaacaauaaccugaugcagcuacugagcaaugaguaucgauucauggaagagguugaaacauacaacaugggaaaacaaaccaagacucucuccuaugagacgguggaaaauauguacguaucuccuagcgucaaaagacagauauggcagacacugaagauugugaaagagcuugagaagguuaugaaggaaucaccaaaaaggguguuuaucgagauggcccgcgaaaagcaagagaguaaacggaccgaauccagaaagaaacaguugauugaccuguauaaggcauguaagaacgaggagaaagauugggucaaggaauuaggugaccaggaggaacagaaacucaggagcgauaagcuguaccuuuauuacacucaaaaaggccgcugcauguacucuggggaggugaucgagcugaaggacuugugggauaauaccaaguaugacauagaucacaucuacccccagucaaaaacaauggacgauagucucaacaaucgaguacuggugaagaaaaaguauaacgccauuaaaagcgacaaguacccgcuaaaugaaaacauccggcacgagcguaagggauucuggaaaucccugcucgauggcgguuuuauuucuaaggaaaaauaugagagacugaucaggaauaccgaacuuucgccugaggaguuggcuggguucauagaacgccagauuguugagacucggcagagcacaaaggcggucgcagaaauccugaaacaaguguuucccgaguccgaaaucguguacgucaaggccggcacgguuucaagauucaggaaagacuuugaguuacucaaggugcgagaggugaacgaucugcaucacgcuaaggacgccuaucuuaacauuguagucggaaauaguuacuacgugaaauucaccaagaacgcaucuugguuuaucaaagaaaauccaggccgcacuuauaaccugaagaaaauguucacaagcggguggaauauugagcggaacggagaaguugccugggagguggguaagaagggcaccauagucacagugaaacagaucaugaauaagaacaauauucuaguuacuagacaggugcaugaagcuaaagggggacucuuugaccagcaaaucaugaagaaaggcaagggucagauugccaucaaggagaccgaugagaggcuggcauccauagaaaaauacgggggcuauaacaaggcggcuggagccuacuucauguugguagagucaaaagacaagaaaggcaagacgauccguaccauugaauuuaucccucuguauuuaaagaauaaaauugagagcgaugagucuaucgcacucaacuuccuggaaaaggggcgcggacuuaaagagcccaagauacuguugaaaaagauuaaaaucgacacacucuucgaugucgacggcuuuaagauguggcuguccggucggacuggggauagacuacuguucaagugugccaaucagcuuauccucgacgagaaaauuauagugaccaugaagaaaaucgugaaguuuauucagaggcgacaagaaaaccgggaacugaaauugagugauaaggacggaaucgauaaugagguccugauggagauuuacaacacauucguugacaaguuagaaaacacuguguaucgcaucagacucagcgagcaggcuaaaacccugauagacaggcagaaggaauuugagcggcuuucucuggaagauaaauccucaacguuguucgagauccuccacauuuuucaaugccagaguagcgccgcaaaucugaagaugaucggcgguccaggcaaagcugggauucuaguaaugaacaauaacaucucgaaguguaauaagauauccauuaucaaccagucucccacaggaaucuucgagaaugaaauugaccugcuuaaaaucuga

SEQ ID NO: 2988 - RNA, 4026 nt, Artificial Sequence
  Cas9 variant
augagauuccagaacaagaaaaccggcgacuacuuuguggggcuggauaucggaacaaauagcgucgguugggccguuacuaacgagaaguaugaaauucucagggcuaaaaaucaccggauguggggcucccgccuuuucgaggaagggaagacggcagaggaacgacgugugcauagagccggaaggcggcgccugaacagaaggaaugaccgguugaugauauuagaggaucuguuugcggaggaaaucucuaaaguagacaaggcuuucuaccaacgccuacacgagucacaguaucgacaggaacauaagaccgugaguggccccuacuuucucuucaacgauaaagaguuuacagacgaggauuaucacauugacuacccuacuaucuaucaucugagagucgcccuuaugaaggcaccagccaaagaugugaggcuguuguuccucgcuauucaccacaucauaaaguaccgggguaauuuucugcaugaaggggagaccuucaaaacaaccggaggccugacugacauccuccagcguguuuuagcaugcaacgaauuuagcggccugaagcaacacauugaugacacagcccuugugaaguugcugaccaauaaagggaucacgcgcuccgauauugcuaagcagaucucugagcuagccacugacaaacucuacagaaagcaggcgaaagcauucgccucgcugguccuuggacugaaggcuaacuuggacgaucucuuuaaugaaccggaguauaaagagcuggacucagaaauaaggaccguggaguucagcgguaaggaauacugggaggaacgggauaaguaugagcccuacuuaggcgagagucuguucgcccucgacggguguaaaacacuuuaugauacucuguugcuauccaacauuaagccugacggaaaauaccugucugaagcaaagguagagaccuuugaaaaacaucacgagcaccucgaaagccugaaggaucuucugaaguccaauaaagcucuauauaaccgaguucuccgcgacgaugagaagaaucugaacaacuacaucacauacauuggcaaaucagaguucaauaagagaugcaguagggacgaauuuuauaaauucuuaaagcagaccaucaaggauaucagcgacaacgagaauaaagccgaaauugugcaacugauggagcuagacucuuuucucccacugcuucggguccgcgagaacggugugauacccuaccagauccaugaagaggaauuggagcagauucugaauguguccucagaaaaguauccuuuccucaacaaagcggaugggagcggauuuacgaucgcccagaagauacugaaacuucugacuuucaggauuccauacuuugucggccccuugaauccugcacacaaggacagagauaacggcuucgcuuggguugugcguaaggccccagggaaaguauauccguggaauuuugaggacaagguggauaucagugcuucugccacagcauucaucgagaaccucaccaauaaauguacuuaccugauuggagaagacgucuuacccaaguauucccuggccuacagcaaauuuucgcuacucaacgagcugaauaaccuucgguacgaugguaagccuuugucuuaugaaacaaaacaauccuucaucaaggacugcuucgagaaggaacaucgaaaaaugaccgagaagagaauuagggaguuucugaaacaccucggcgggacggauggaaagggcgcucugaccgguuuagacguggauauaaaaucagaccugaagaguuaccgcgauaugguucggauccuuggggacggcuucgacgaaacaauggcggagagaauuaucagguaugugacuuuguuuggagaagcaaagaaaguccuccugagcacccuagagaucgaguucggcgaugaccuguccgauacacagaagaaacagauucucaagcugcaauaccgcgacugggggcgacuuucugccacuuugcugaaaggaauaaaggguguggcuggcgauaauccagaauguagcaucuuagagugcauggaacagcagccccucaaccugauggagguacuuucaagucauaacaccuaucuggccgcaauugaagaguuuaauaaggagcggacagaaccuaccgacaucguugauuacaaauugguggacgaucucuauauuuccccagccgucaagcguagcguguggcagacucugagaauccuagacgagauaacgaaacugagggggucuguccccaagaaaguguucguugaaguggcucgcacaaaccgggccgagaagaagaaaaccgauucaagaaaggaaaggcuccugcaacuuuacaaaacuaucaaggacgagggacgaaauuggaccgaggaaauuaaacagcgcgaugcaggcgacuuuaacaguaagaaauuguuccuguacuauacacagcagggucgguguauguacagcggggagaagaucaccuccauuggcgacuuauuuacuucuaaguaugauaucgaccacauauacccgagaucgguaacaaaagauaauagcugggacaaccucguccuggugaaggcggaacuuaauagggagaaaaaggauauuuauccuaucgaaaaagacacgcaagaucguugcauuucccuguggaagcagcuacucgagcagggacugaucucagagcgcaaguacgaacgguugguuagaaccacuccccugacagcugacgaguuagccgauuucgugaacaggcagcucgucgaaaccaaucaaagugugaaagcaguaacaaaccugcuuaagcgacuguauccagacacuaccauauguuacgugaaagccgagaauguuucugauuuucggcaggaacgcgaguucgucaaguugagaagccucaacgcucaccaucacgccaaagacgcauaccugaauaucguggugggcaacgucuaucaugagaaguuuacgaauaacccuaggaacuucauuaagaaugcucgguccgacaaaaagcgacccuacucacuaaaccacauguucgauuaucugcuucagguugggaauaaagaaaucuggaacccaaagaccgacaauaaccucgugaaaaagaugaugagaaauaacgaugugcagguaacacgcaugcuggucgagcaaacuggagccuuguacgacgcgaccauuuauaaggccagcgugacaaaaucugaauccuacguuccccugaagaguagcgaugcuaucuuaucugacgugaaaaaguaugguggcuuuacuuccauaaaaauugcauacuacucaaucuucagguuuuauaagaagaauagugaggaguucgaaacccacaucauuagcaucccuguccucaaagccgggacgcugaacucgaaggaggauuacguggcuuauggagaagagauuaugaauaaacagaaguuugaccguguugaacuuguguacaaaaagcugugcaugaacuccuugguacggauaaauggcgucauguauuaccucggugggaaaacaaacaauucucuguauaucgauagcgccauuucauuggugcugccagacaacaucgcaaagaagauuaaagcgguggagaaguacaucgccagagucgcugagaacggcaauuacaaaccgcagcccgaucaaguuaguccugaauuuaacaugauaaucuauaaggcccuuaccgagaaaaugaagcagccagcauucgugggacucaagacuaauagggaaaacgagcuggaaaaagagacaaccauuacugcuuucaucgccaugaccuugauugagcaguguaagauguuaauggaaauccugaaucuccugacacagcagaaaacgaccuacgcacuuaagcccauaggcguauccgccucucgcagcacucuggggaugaacauuacaggauuguccgaguuuaccaucaucacacaaucagugacuggccuacaggaaaaagagauucgaauaaucuga

SEQ ID NO: 2989 - RNA, 4026 nt, Artificial Sequence
  Cas9 variant
auguggggcagcagacuguucgaggaagccuccaccgcucaggacaggcgggagcaccgcucuaaccgacguagacucgaaaggcggaaguaccgccuugaucuguuggaggaauuauuuguggaggagaucaauaaaauugaccccgaguucuuuauaagacugagggagucaaaguuccauuuugaagaucggagucuuaaaaacacauucauccucuuuaaugacaagauggaagggggauauaacgauaaagucuucuuuagcaaguacccuacuauuuaucaucugcgcuccgcacuuaucaaugguaacaaggaggacguucgagccguguuccuggcgauucacaauaucuugaaaaacagaggccacuuucuccuggcugggaaugauauaaacaucucucugucgcucaaugacacguuaaccgaucuguucgaauaccuuaagauucauuugggaaucgagguagaauuugagaacaaacugaaggacauugagaaaaucgcccuagauaagaaucucucaaagagcgacaaacaaaagaaaauagugcagcugcuugaaacagauuauaagaaacagcuggcagacgucuucaaguugagucucggccugacugccaacauggagaauauuuucgguaaagaaaacgagcagggguuagaauuuaucaacgcugagaauaagauuaagaaaauccaauucgacuccucuuacgaagagaacaucgcagaguuugaucaguucuauggagaauacuuugagauuauagacaucugcaagaaaauuuacgaugccaucagccugucccagauacucguggacggcaagggccuuucagaaaguaaaguucugagcuaugagaagcacaaggaagauuugaaacuacugaagaaagugcucaagaauauugacaaggcuuacgauaacaaaggggaggacaggcuggucuauaaggugcuuaaagaggauaaggacaaaggaaccaauuacguaaacuauucuaagcuguccaauaacgguacagccaccacuaaagaagaguucuacaaguuuuugucaaagaaucucgaucugaaaaaguucggcaaauuaaacaaggaagacaucgagacacuggacuauaucaauagcgagauucuacucgggcgguuucugccacuucagaaagaaaagaucaacggaguuauuccguaccaauugcagaugaaagagcugacccagauacucaauaacgcgaguaaguaccugcccuuccuuaauaagaucgaagauggcaugacggugaaagacaagauuaucucucugaucaaauuucguauuccuuauuacgucgguccauugaacgaguauaaccgcauagaaaaugggaacggauucgcauggaucgagaagaaaaagaaugagaagauuuuucccuggaacuucaaugaugugguggacaucgaaaaauccgccgagaaguucauuaacaaucucacuaacaaauguaccuacaucaaggaagagacaguccugccuaaaaauagcauaaucuauucgaaguuuaugguuuuaaacgaacugaauaaccuacaguacggcaauaagaaacucgauauugagcugaagaugaaaauguauacugaccuuuucuuggagaagaaagauaacagaaaggugaccgaaaagaggauccuggaguacuuucggauuaauggcaucaacgacgggaaagaaaagcucacaggacugaacaaugagauacacgcugauaugaaaucuuaccgagacaugugcgaaauuaugggugagaacuucaauaucaacguagccgagaauauuaucaacuggauaaccguguuucauggcgaaaagaaaaucuuaauuaauaagaucaaaaacgucuaugggaagauguucaaugaugagcaaauuuccaagcugucaaaacuuaacuacagugacuggggacgcuugagcaagaaacuccugacggauaucaaguguuauauagacgcagacggcauuaauuuuccaguguccauccuagaagcuauggagguuucuaacaaaaaucugauggagcuccugagcaacaaguacgaguucaucucaugcauugaugacaucaauaacaaguauuuuggugauagagacauuagugccuccgaacuuauagaugaauuguacgugagccccgcggucaaaagggggaucuggcagucugugcggauucuggaggaaaucguaucaauuaucggccacaacccuaagaaaauauucaucgagaugacucgccauaaugaggaaaagguucagaaaaguagcagaaggcacaacuuagaggaacucuauaaggccauucguaaggacccagaguacguggaacugaucaaagaguuugauuccacaaccgacacugauucuuucaagauuaaaaagcuauaccuguauuuuaugcaauugggaaaaugugcauacucgaaggagaagaucgacuucgauaaacucuucacagacagcuaugauauagaccacauuuacccgcgguccaagaccaaagacgauucaauccauaauaaccugguccuagugaaggcuaaauauaaucgagaaaagacggacgucuaccccaucgauauuaacauacagaagaauaugaacaguuuuuggaauuuccuguauaccaaaaaguuuaucacagaggaaaaauacaagagacucauuaggacuucugaccugaccgaugaggaacuugccaaauucaucagccgccaguugguggagacaucccagucaacuaaggcuaccgccgagguucugaaacaaauuuacggcgacagcgauaucugcuaugugaaggcagaaaacguaucugacuuucgguacggguccaguagacagaaggauaaaaaugacauacagaaguuauucgucaaauguagggaggugaaccacuuucaucacgccaaggaugcuuaucucaauaucguugugggaaacgucuacgacgugaaauucacaaagaauccuguaaacuuuauuaagaaaaauaagauggguaacaaaagcaacuauucucugaaucauauguucugcuuugacguggaacgcaacggcuacaaggcgugggauuccucagagaccaucaaaacuguugggcgaaugaugaagaguaaugacguccggauuacgaagcacgugcacccaacacguggagagcuuuaugaugcaaccaucuacaaagccaagauagcuaaaacuggcagcuacaugccccugaagucguccaaaaacaccccucuaucugacgugacaaaguaugguggguacaccaagauuaaaaucgccuauuacagcgucuauaaguacaaauucucagauaagaaucucaucaaaacugaaauuagacugaucccaauacccauuuauuugaguaagaacgacgaugacaucaaagaguacguuaagaauuaccugaacgauaggguaaauuccaaguuaauugacuucacaaaaaucuaugauaagcucuacgugaacucucugauaaaaauuaauggcuaucuuuacuaucugggaggcaagacgaacgaccgcguguggaucgauaaugcagucagcaucguguuggacgacaaaauugaauaccucaucaagcggauuuccaacgauauaaaguauggguacgagaucaauguuucagacgaugaacugauggacauuuacgagagccuagccgagaaagcuaacaagaaaaucuuuuauaacagacugagugauuucgaaaagaucuuuucuaauauggacgugaaaaagaaguucgucaaacuugagaagaacgauaaauguagggugcuccugcaguugcugaauguuuuaaccgacucccaaacuacauacaagcucgaaauggugggacugaaacauagccgaucgaacauugguaugaagauaucaaaucuugaggaauuuaagguaaucaacucuaguauuaccggccuguauuccaaugagaucgauauuuugaacaucuga

SEQ ID NO: 2990 - RNA, 4026 nt, Artificial Sequence
  Cas9 variant
auggagaaggacuacuaucugggccucgauauggggagcggauccgccgguugggcugugaccgacgaucaguaccacguccuuagagcacauggcaaagccaugugggggacaaggcuguucgaaucugcgaacacugcugaggaacggcgcaucaaucgaacggcccguagaagguugaagcggcgcaaccaaagaauugagugguuacaggaaauauuugcagaggagaucaauaccaaagacucaggauucuuuaggcggaugaaggaaagucgcuauugggccgaggauaaacgagacgaaaacggcagcugccccgagaugccuuacucccuguucauugaugaggacuuuacagauaaggaauaucacgagaaguucccaacuaucuaccaucuaagaaaauaucucaugaccacagaagagaccccggguauuaggcugguuuaccuugcuuuucaccauaugaugaagcaccgggggcacuuccuguugaauggaaacaucgaagagauacguaaauuucgcaagacuuucgaccaguuucucgaggugguaagaaaugaagagaugggcuucgcaggcgaaaucgaggaagagacauacaaaaagauugagaugacccugaaggaugugaaccugacgaggucugccaaaaagacuacccucaucaaaucguuaaaggucacacggguggaagagaaagaacugcuugcuuugauuucaggguguacuguuaagcugagcaauaucuuuaacgacaaaagucuagaugagaccgaacgacccaagauauccuucgccgacgcgggauucgacgauuaugaggcagagauucagucuaaucucaacgaaaaguacuauaucauugagagcgccaaagcuguguacgacugggccgcacuggcugauauccuuggugaauauuccugcaucucagaggccaaggucgcgcuguacgagaaacaucacaaggacuugaaacgccucaaggaucuggugagaaauaacauuaguagcgaaguauauaaggagauauuuguugacgugucuggcaaauacaagaauuacugugccuauaucgggacaaccaacauuaacggaaagaagaaagauuucgaaggcaagaagugcacgaaagaggacuuuuacgcauauuuaaagaaauccgucaucgaauguauaaaugauucagagaagacugacuggcugaaacucgagcuugaaaaggguaacuuccugccuaagcaauugacaggggagaauagcgugauuccauaccaggugcaucuauaugaacugaacgcuaucaucaccaaucuccaggagaggauuccccugcuuaaacgggauggagaaaagauccgccagauuuuuacuuucagagucccuuacuauguuggcccacugaacggcauaaguaucgacgggaaaaagacaaauugggugaaaaggaaggagggaguaauuuaccccuggaacuuuucugacaucguggaugaggaauccagcgccgagucguucauccgucggaugaccaauaaaugcacguacuugauucacgaagacguccucccuaaguauucucuguuauacucccgauuugaggugcugaacgaacuaaauaacguuagacucaauggugagcugcuuucaguggaguugaagcagaaaauauaugaagaugucuuccagagguaccgcaaggugacccagaaacggcugaagagauaucuccugacagagggcaucauugacgaaaacacuguaaucaccgggcuugauggagacuuuaaaggcagucugacagcuuaccacgauuucaaggagaaguugacuggucucaaucugaccgagagggaaaaagaggaaauuaucuuaaacauaacacuguuuggggacgcccgcagccuacuccgaaagcggaucggcaaaauuuguucccagcugucugauaagcaaaaagagaaccuuagcaaguugucauaucagggauggggccgucugaguaagaaauuccucaaugggaucgcaauuuccguucagggagaagaggaguggaccaucauaaaggcccugugggaaacucaagacaacuuaagccagcugaugggugcuaaauacacguucagaaaugcgguggagaaggaaaacggcgagcuugaaaauagggagauuucuuacgagacagucaaagauuugucaaucaguccaagcgugaagcgccaggucuggcagucccuccugauugugaaggaaaucugcaaaauacaaaagaaaccgccccggaagguuuuuguggagguagcaaaagaaaagaccaacucugggagaacugagucgaggaaaaagcgacuacaggacuucuauaaguacuguagcaaauaugaaaaggagcuguacgaugaguccauccagaauaaacucgaaaagugcucagagagugaccugcgcucugacaaauuauuuuuguauuacaugcagaugggacgguguauguauaccggccaaccuauugauuucgacgaacuguggaacaaucagaaguacgauaucgaccauauuuacccacagagcaagacaauggaugacuccaucgauaacagagucuuagugaaaaggauaucaaaucaggagaagaccgacguuuaucccauucgugccgauauccgcgagaaacggagagguuuuuggaaggaacucaaaaacguggggcugaucagcgaggaaaaguacaagaggcuuacucgagcuacagaguucgaaccugccgagcuggcaggcuuuauuucucggcaauuggucgagaaucgccagacgaccaaagugguagccuccauccucaagcaggcuaugccagacacugaaauuguguauguuaaagccagaacagucagugaguucaggcacaaguuuaacuucauaaaagugcgggaaaugaaugauuuucaucacgcaaaggacgcguaccugaacguggucguuggaaacaccuaucuagugaaguucacaaaaagccccgugaauuuuaucgagaaccauucuaaucgauccuacaaccugaagaaaauguucacugauggcagaguagaacgcaauggggagauugcuuggaucucaggagagaacgguaccauuggcacggucaggaauaucaugaagaaaaacaauauacucgugacccgucgggcccacgaagcaacagggggauucuuugaccagcaacugaugaagaagggcaaaggucagguuccggugaaggggagugacgagagacuuuuggauaucgaaaaauauggcggauacaacaaggagacuggcgccuacuucguccugguggaaagcgacgagaaaaaggggaaaaagaagaggaccauugaguauguuccuauccgccuuaaaaagcagcucgaaaauaaccgaaaagcucuggagaauuaccuuugcgaacaaagaggacugacaaaccccgugguacuaauugauaagaucaaaauggacucgcucuuucgggucgauggcuucuuuauguggcuguccgguaggacugggaaucaguugcuguucaagugcgccaaccaguuagugcucucuaccgaggacgaggcaacgcugaagaaaauagugaaguuugucaaccgccguaaagaaaauaaggagauuaaaaucuaugaaagcgauaaacuuaacgaggaaaugcugaauagauuguacaacacauuccucuauaagcugcaaaauucaaucuacggaaaccggcuaggcgagcaagcuaaaacccugaguuccaagaaagagaauuuugacaaacuucagauugaagagaagugucucguucuguaugaaauauugcacauguuccagugccagucugccacuagcgaucugcaauuaaucgaggguccaggcaaggcggggacacucaggcugaacuccaauauuaccaaguacaaaaacaucaauauuaucaaccagucaccuacuggaauauacgaacaggugaucgaccuucagaagauuuga

SEQ ID NO: 2991 - RNA, 4026 nt, Artificial Sequence
  Cas9 variant
augggcaagggguacuaugugggacuggacauggguaccggcagcgucgggugggccguuacagaugaguccuaccagauccucagaaggcacggaaaagcuauguggggcgugcggcuuuucgaaucugcaaagacugccgaggaacgccgaauguuucguacggguagaaggcggcuggaccgcagaggguggaggauugagauauugcaagaaaucuucgcggaggagauuucacggguagaucccggauuuuucuuacgcaugaaagaaaguaaguauuacccugaggacaaacgagauauccagggcaacugcccagaacugccguauacccuauuuguggacaagacauucacugauaaggacuuucauaaaaaguaccccaccauuuaucaccucagaaaaaugcugauggagacagaggauaccccugacaugaggcuugucuaccuggcuuugcaucacaugaugaagcaucggggccacuuccuccugagcggggauaucucccaggugacugaauuuaaaaauacauucaaccaguuuauagagaauauccguaacgaagagauggacuucgaaauugagcuggaugagucugccguucaaaugaucgaagagacccucaaggacaagaauuuaacgcgcucggcuaaaaagucaaaacuggugaagggacuuaacgccaaaaaugucagagacaaggcauuuuugacucugcuaagcgguggcaccgugaaacucagugaucuguucgggauggaggagcuuaacgaaggagagaggccaaagauuuccuucgcagacaauggcuacgaggaauaugccgcuguaguugagauggaacugggugaguuguacuauaucguggaaucugccaaggcggucuacgauugggcaauacucagcgacauucuagggggauccacaucagugagugaugccaaagugcgggcuuaugagaagcacaaagccgacuuaaaguaccugaaagcagucguuaaggaguauuuucccaaggaaguguacaacgcuguauucguggagagcucugauaaacucaauaacuacccugccuauaucggcaugacuaagaaaaauggcaagaaagucucccuugaagggaagcgauguucacgcgaggaguuuauggacuuccugaagaaaaacauugugguuaaguugccagaugaagaggcgaaaauguaccuacagagcgaacuggagaaggacaguuuucuccccaaacaggugaauaaggauaacggagucaucccuuaucaggugcauaaguacgaacugaaaaagauccuugacaaccugggugacaaaauuccauucuugaaggagaaugccgagaaaauagaaaagcucuuuucuuucagaaucccguauuacguaggcccccugaggaccgggaacggagaaaauuccaaauuugcaugggcugaacgcaagagcacagagaagauuuauccuuggaacuucgaaaauguuaucgauguggagcaaucggccgagaacuuuauacggagaaugaccaauaaaugcacguacuuaauuggcgaagacguccugccaaaggauucucuacucuacuccaaauucauggugcugaacgagcuuaauaacuugaggcuggacggucagaagaucucagucgaacucaaacagaagaucuaucgugauguguuuugucggagucgaaagguuacucagaaaaagcugaaaagcuaccuuauuagagaggggaucgcuggcaagaauguggaacugacaggaauugacggcgauuucaaaggguccuugaccgccuaucacgacuucaaggagaagcucauagauguagagcugacucaaaaagaaaaggaggaaaucauuuuaaacaucguccuguuuggagacgauaaaaagcuacucaaacagaggcugaagaagaaauucccccagcuuacagagaagcaaaucaauaccgugacggcauugucuuacaaagguuggggccgccugagcaagaaacuccuggaggaaguuaccgugccugccccagagacaggggaagucuggaacauuauaacugcuuuaugggagaccaaugacaacuuuaugcagcugcuuucaaaggaauaucaguucagugaucggaucgaggaguuuaacgaagagaaagcggaccccgaaguguccuaccagacaauugaggacuuguauguaagcccggcagugaagagacaaaucuggcagacucuccagauuauccaggaaauagagaagguuaugggagagaaaccuaagagggucuucguggaaauggcccgcgagaaacaagaaaauaagcgaaccgagucucggaaaaagacacugucagaucuauacaccaagugcaaaaaggaggaacccgaguggaucgaagcucuguguacgagucucgagaaacaugaggaacaccagcugcguagcgacaaacuuuacuuguauuacacucagaaaggcagaugcauguauuccggugagccaauugaucuggaagacuuaugggauaacacaaaguacgacaucgaucacauuuauccucagucuaagaccauggacgauucgcucaaaaauagggugcuggucaagaaagaguacaacgccaagaaaagcgacacuuaucccaucgcagccgauauacaaaagaagaugaugccauuuuggaaaucccuucugaccgggggcuucauucccaaggaaaaauacgaccgcuugguucggaauaacccucucgaugcuaaugagcuggccggauuuaucgaaagacagauuguggagacaaggcagucaaccaaggcaguggcggagauccugaaaaagauacugccagacacugaaaucguauacgucaaggcuaaaacagugaguaaguuccgacaggacuuugauuucauuaaaguucgcgacaugaacgaucuccaucacgccaaggacgcauaucugaauaucguggucggcaacguguacuuuguuaaauucacgaagaaugccgcuugguucgugaaagagaacccggggcggaccuauaaucuugaaaagauguuuauuugggauguagccagagacggagagaucgcauggaaggcugguaaaucuggcagcauaguccaagugagggccaugauggaaaagaaccauauuuuggugacucgucgcuccuacgaggucaaagggggacuguucgaucagcagaucuuaaagaaaggcaagggucaaguucccgugaaggagucagacgaacggcucagagauaucgggaaauauggcggauacaauaaggcggccggcguauauuuuaugcuggugagcucuaaagacaagaaagggaaggagcagaggacaauugaguucgucccuaucuaccuuaaggaucgaguggaaaaagacauggaauccgcucggaacuaccugauggaggagcgcggacuaagagaaccaaagauucucauaaagaagaucaaaauugacacccuguuuaagguugauggcuucuauaugugguugagugguaggacaagcaaccagcugaucuuuaagggggcaaaucaguuaauucucucuaaagaggacaugaagacucugaaaaagguggucaaauacauccaacggcagaaggaagauaaaaacgugaagauauccaugcgagacggaaucaccgaggaggaacuucugaaguuguaugagacguuccucgauaaaauuagacacucaaucuacggcgcccgccugaguagccaggaaaagacccuaguuaaugguaaagagaaguuuauugaccugucgguggaagcuaaaugucagguccuuuaugagauccuccaucuguuccaaugccaguccggcgccgcaaacuugaagaugauagggggacccgcgucugccggcauucugguaaugaauaacaauaucagcaaguguaaaaacaucucaauugugaaucagaguccuacagggauauacgagaaggaaaucgauuuacucaggguuuga

SEQ ID NO: 2992 - RNA, 4026 nt, Artificial Sequence
  Cas9 variant
augacccagaaggugauccccuacaacauuggccuggacauagggacaaauagcgucggaugggccguuacugauaacgagaauaaacuccuucacaucaagggucauaacggcauuggggugagacuguucaaagaaggacaauccgcugcagagaggugcggcuuucggacgacccgccgacguuugucuagaaggaaguggcgguuacgccugcuaaaugaaaucuucgccgacaaaauugcgaagguagauccuucauuuuucgcuagacucaagcagaguaacgugagcccaaaagacccgaauaagacaauguuugguaacauccuguucgauaaugggaaccuuaaugacaaauccuuucacgaugaguauaagacuauauaccaucugaggcagucuaucauugaccaccccgagaaaaaguucgauauccgguugauuuaucucgccaugcaucacaucauaaaguaccgcggacacuuucugaaccaggcaaauguccaagacuucaaaggcggcaagauugaucuggaagagucguuuaaagaccucaacucaaucuucgaaaaucaggggcgagauuuaagacuggugaccgaggacgccaacaaguauguuaaagaacuuagcgacaacaguaagacaaggaaugaucggcagaaagaguuguccaaggugcuguacauuccuaucgacaagaacucugauaaaaauaacaagaaagucaccacugagaucauuaaggcuauacuaggaaugaaagcaaaguuugacgugaucuucgguauugaugccgaaaaugcuaaggaguggagccucacauucaacuccgacgauuuugacgauaaaaucgaaggccugucagcccagaugaccgacgaggcgggggaaauacuucugauuuugaaggagcucuauuucgcacugaauuuaagugauauccugaacaauagcguaacggacaaaaacgccaagacucucucugaggcuaugaucaaucguuacgacgaucauaaagaacaacuuaccaugcugaagcagguuauugacaacuccgauaagaaacacgccaaggcauugaaagcugccuacucagcguauaucgacggagagaauaacaagaaaauuagcuuugaagaucuacgcaagagaauacagaagaaucuggacaacagugagacaucuaaaaagaucaacgaucuccuggaacaugacuacuuccuuccaaaacagagguccaaggagaauggcgccauuccccaccaacugcagcagcaagaguuggauaaaaucaucgaaagccagaagcacuauuacccuuuucucgcagagcugaacccaaaugaaaaacggucgcgacaggcuaaguauaaguuagacgagcugguggccuuccgcguccccuacuauguggguccuauggugaaagcuacugaaaacaaucagucuaacaaugggaaguuugccuggaugauuaaaaacgauaauauauccgacaagcucaaaaaggaggagaucaccccauggaacuucgauaagaaagucgacagaacagaaaccgcaacgaaguuuauuacuaggaugacaaccacugacacauaccuaaucggagagccgguucugcccaaaaauucacuuuuguaccaaaaguucgugguacugaacgaacucaauaaccugaaaauuaauaagcagccuaucaccccagagcagaagcaguauguguacgagcaugucaugaaacaaacgaagcgggugagucuuaaaaagauagccgaugcucugguuaucaaaggcgacuaucccuacgcgccugaaauuaccggcacaacugaucagaagaacaugaacaauggguugagcaccuauaucgaccucgcaaagauuuuuggagaugagcuggacgauaucgaccgcaaagaagauuucgagaagauaauugaaugguccacaaucuuugaggaccagcacauuuucgccuuaaaacugaaggagaucaaauggcuaacugaagaucagagaaagcaaguggucaaacucagguaccaggguuggggcaagcugucuaagaaacuuuuggcugaccugguggaugacaacgggcagcguauaaucgaccuccugugggauagcaagcaggacuucaugcaaauuguaaaucagaacucauuuaaacaggccaucgcagagcauaauggagcccacuuagaagagaaggaucugaaagacauuaucaacaaucuuuauaccaguccacaaaacaagaaggcuauacggcagguuauuuugguggucgaugacaucauccgagccgugggcuacgaacccgucaauauuaugauggaguucgcaagagaggauuccaaagaccauaggcucacaaacagccgcucucggcagcuggaaaagguguacaaagauaucaccaauucaugguuugacgaugacaacguuaaggacgagcuaaaagauaagauuaaggacaaagcgaaguucacugauagacuguaucucuacuuuacgcagggugggaaagaccuguauacaggcgaaccgcuugauauagacaauuugaguaacuaccaaaucgaucacauucugccucagagcuucaucuuagacaauucccucgauaacagggugcugaccucuaagauuaacaaucagaucaaaaaggacaaccuucccggagaguuuuucggcucgaagaugcacaauuuuuggaaacaucugaaggaauugcaccucauaagcaacaaaaaguauuacaaucugacucuaaccccaaacuccaucucaaaauucaauaaccaggggcgcuuuauuaaucgacaacugguagagacacggcaggucaucaagcucgcugccgagauucugcauaaccguuauagugaagagaauggaaccaacaucgugacuguuaaggcaaaucuuacacaccacaugagagaaaaauucaacuuuuacaagaauaggaacgugaaugauuaccaucacgccuucgacgcuuauuuggccgcauucgucgguaacuggcuguuacagcaguacccuaaacucaagcccuauuuuguguacggcgauuucgcuaaaacggagauagacaaccugaagucuuuuaaucuuauuuauaaauucgagcaagcccaucagcugaacgaagaggacgggaagaucgcgaaggauaccgacgcccuacucggauacaugaaaaauguauaucacuuuaagaaaaugcuggugacuaaggaauuggagacaaaccauggcaaucuguucaaacagaccuuauacccaagccacgguaagaugaagaaccucaucaaucccaaagaaaaccgcuccucagauauuuacgggggcuauagcucugagacaggagcuuacguuucccugauaaaggucuuuaaaaagaauaaaaucgagaacaagauuaucaagauuccucuucuguauaucgacaaauugaaucggcaagcaaacgccaagcaguucauaagaaauuuuaucauuaaagaugacaguaacaaguucgauauccucagcgagaaaauuuuucugaaucagcuagugaucgacggcgaugaacuguucacuauaucuggguccggagacaggcagaacgcucaacagcuuauucucucagauaagagucugaagaucuugagcaaaaacaucaaugugauuucgaagaacgaccugaucauaauuuucaaugaaaucauugaugacaucuguaaauacaugaagauguaugaggucgaaaacuccgacgagaccaaagccaaguuugaggaaauaaaugauaaagaccgaauguuaaagauuaucaacgaucuccugcuuggucugcacgcaaaugcgucucgcagcaacuugucaaguaucggccucuccccaucuuucgggcgguuuuucagcggaaaugccggcauuaagcuguccgagaacgcuaaauuuaucuaccagucaccgacgggucuauucagcagaaagguuaaaauuagugaccuguga

SEQ ID NO: 2993 - RNA, 4032 nt, Artificial Sequence
  Cas9 variant
augaccuacuaucugggccucgacauggggacaagcuccgugggaugggccgucacugaugagaacuacaaucuuauccacagacauaggaaggaccugugggguauucgggaguucgaagaagcuaaaacggcaguugagcgccgaacccagcguauaucuagaaggcggcgccaaagagaaguggccaggaucggcuuguuaaaggauuauuuucacgacgagauucagaaaguagaucccaacuucuaccagcggcuggacaauucaaaguauuuuccugaggauaaagaagagguggucaaggggaagaacggaaucuucgcggacgaaaauuacacagaucgcgacuauuuugcugaguacccaacuauuuuccaucuacgaagagagcuccugaacaguaaagaaccgcacgaugugaggcuucuguacuuggcccuccugaauauguauaagcaucggggccacuuucugaacaccacacucgguaccgacggggagaaucguaaauuaagcgauguuuaccgcgacuucguggucaagacugaagaggugcugggacuuacauuuccccaggaaaccgacaacggcaaaaugcaagagaucaugugcuccagagaguucucuaggaagcggaaggcagaauugcugugugcccuacucgagauagauaaaaagcagaaacagcagguagcucugaucgaaugcguucuuggccuggacaagucggugaaacaaauguaugggacggcagucccugaugacuuugauaagucagugaaagugaauuucagcgacaguuccuuugaggaaaaggucucugagguugaggaauugcucgaugaggaaaaguacgagcugauuuuauguaugaaagaacuguaugacacugccgugcucaaccagaucaugggagauugcaauuaccuuagcgaggcucgaguacaggaguaugaaaagcacaaagaggaccugaaguugcuaaaacgcaccgugaagaaguacgguacagccgaagaguaccaguuccuguucagauccucagagaaagcgaguuauaacgcauacguccauagcguuaauucuggcgaaaagauuaggcggaacauggaugggcgcuccagagacgaccucuauacugugcugaaaaagaugcuuaaaaacuacccacaagaggaugccgacuguaaguauauccuggaagagauagaaaaggagcaguuuuugcccaaacagcucgugucagauaauggagucauuccuaaccaaauccacuacaaggagaugaaaaagauucuggaaaaugcugagcaguauuuacauuuccugagggaaaaagacgagagcggcuacaccguggccgaacguauccuaaagcucuuugcauuccagaucccauacuauauuggucccacaagugagaagucugggaaaaacggaggcaauggcuggguaguucggaaggagcaggggcaagugcugccuuggaacauagaagagaaaaucgauaugaaggcuaccuccgaaacguuuauuagccgaauggucagaaggugcacuuaccuuucggacgagaugguguugccaaaagccucucuggaauaugaguccuucuguguccucaaugagcugaacaaucuucgcauccggggagugaagcugccgauaacaguuaaacaggauauuuacaaggacuuguuugaaagagguaagagggugacccgcaaacagaucguaaacuaucucaagggcgucgggauccugcaggagggagaagaggaugaguuaacuggcaugauggacacauucaauucaagucuggcgagcuacgguaaauuuaaguccauucuaggggagaaaauccaagaagauucuugcaagcgaaugguggaacagauuauauucugguguaccaucuauggcgacgccaagaaauuucucaaggagcagcuggaagagaaauacggagauguucuuacgcgggagcagauuaagcguaucuugggcuucaaacugaaggacugggggaaccucagcaagaaauuucuggaauuaaauggaugcgacagaaacaccggugaggugaugucacugaucaggaugcuuugggaaagugaugacaauuugauggagcuccugaaggauuccagcuacacauaucgcgcagaacuagaggagcaacaggaaaaacugacuaagacccucacagagauuugucccgaagaccuggagggcuacuauuucucugcuccugucaaacggaugauauggcagacucuuuugauccugaaggaaguggagaagguaaugggggagccacccaaaagaguguucguugaaaugaccagggagcacgaugaacgacgcgagaugaaggacucacggggcaaaaaguuucaggaguuauacaaaaacauuaaggaugaggaacacaacuggaaagccgaaaucgaggacgcugaaaaggauggaagaauuaggaguaagaaaauguaucucuaccugacacaacguggucgcugcauguauaccgggaauccuaucgaccuugaggagcuguucacuacgaaguacgauauagaccauaucuacccacggcacuuugucaaagaugacaacuuggacaauaaccucgugcugguggaaaaggagaaaaaugcccauaagagcgaucaguauccccuaggcgacgauauuuacacaggaagacuguccugguggaaggaacuccacagggagaaacugaucaacgacgaaaaguauaaacgacuuaccggccgggcaccguucucugaugagcagaaggccggguuuauugcucgccaauuggucgagacuucgcagggaaccaaagguguugcgagcauccugaaggaaguguuaccugagacaaccacuauaguguacgcaaaggccagaaauguauccgacuucaggaacacaaaugaacuccugaaagcucggucagucaacgauuuucaucacgcccaggacgcauaucuuaauauugugguuggcaacguguacuaugucaaguucacgaauaacccccugaauuuugugcgaaguggggagggauacaaccuagauggcguuuuccgcaaaaacgugaucagaggucaggaaaaugccuggauuguaaagccagagaaaggggagaagaugacccucgaaacugucaagagggugauggcuaaaaacacaccucuguugacccgucugucuuuugagggccggggaggcuuagccaaucaaacacucuacagcgcaaaggaagcggcuggggagggauaugugccccugaaauccucagacagcagacuucaggaugucacuaaguacggcgguuucaccucuguuacgaccgccuauuuuauccugguggagcacgacaugaaaaagaagaggguacgcacaauagaauccgugccaaucuuguggaaagagcgaauugaaaaggagagugggcagcucgaaaucuacugcagagaggcacugggccuagucaaccccgacauucgggugaggaaaauccugauacagagccuuguuaagaaagauggauucuauaugcaucucucugguaagacuggcaaucgcuucauuaugcguaacgccguggagcuguguuugaaacaagaauggaucaauuacuccaagaagcuggagaaagaagggugcgacgagucaaucaccaaggagaaaaacgaagaguuauaugaaauucucaaggagaaacacaucaauggaauuuacagaaagcggccuaacccaaugggcgaaaagcugcauauaaggcaggagacauuucgcaugcuuacucuggaggaacagaaaaaggucuugcucagucugcuaaaucugaccaaaaucgggccgguggaggcuaaccuugaacucauuggagagagcgcccacacgggcaagaugcugaucucgaaaaauauuacagaaguuaaggaguucuacuugauccaccaguccgugaccgguauauaugagaagcaagucaacuuacugacuguauga

SEQ ID NO: 2994 - RNA, 4032 nt, Artificial Sequence
  Cas9 variant
auggccaccaagaaagaguacaacaucggccuggacauugggacaacuagcgugggaugguccgucguugaaacggauaaucagaaggugaugagaaaagguaacaaggcucucuggggcguaaggcuuuucgaggaagcaaccacagccgagucucggcgcaugcaacgaucaacucguagaagguaugaccggcgcagagaaaggauaaaacuguugcaggaggaguuuagugaagagaucaauaagguggauaagaacuucuuucagaaauuaaaggaaagcaaauacgucgagaaugacaagauuaacaaaaagaucgugcugaccaaggaggaaaaacaggagcuaaaggauuaucaaaauaaauacaagacaauuuaucaccuccgggacgaacugaucaacaaucccgagaaaaaggauauacgccuuguuuaccuggcgauccaucacauuaucaaauaucgagggaacuucuuguaccagaaugcuaacuuuaauauugacaaccucgauaucaaggacaagcugaaugaacuguucuccauacucucuaacaacauucaggaguuagagaucccugaagauuacauuaauaucaucgacuuugaugagcuggaagccgaccuuuugaaagacaccaagaacgaugugaaagcacugcuaauugacaaucucacugagcugacaaacaagucgucagccaccgaguucggaaaacuuauggucggcaauaaggguaacauaaauaagcuguugaugcucgagacggauaacaaaaucgagauuagcuuuagugggacugacuaugaugacaaguacgaagaguaucaggaagcucugggagagaauaucgaaauauuagauauucugaaacaaaucuacgacugcaucuuccucaagaaaauuuuuaagggcaacaagaauaccuccaucucuagccuuauggugaaauccuucgagcagcauaagaaagaucugaacuuuuugaaggagcuauucaaagacaauagagaacuguauaacgagauuuucaggacaaagaaggaucucugucuguacgaaaaauauauaacuaauaagaucgacugcgacgaguuucggaaagagauuaacaaacuucuggaaucauuguucagugaugagaacaucaagcagaaucuccuggacgaauacaacuuagagguaaaggaacguaucgagaauggcaccuuucugccacgcauuacaaccacggauaacgggaaauacccguaucagcuaaauaagagcgagcucauaaagaucauugaaaaccaaggaaaauacuaucccuuccugcuuaauaaguugaacgacaauaaaacuuacaagaucguuaaacugcucgaguuuaggauuccuuauuacguggguccacuggucucugaaaagagguccgagaacucauggcuugaacggaagaucaauaacgugaaaauaacacccuauaauuucgaugacguggucgauaaggagaaaaccgcagagaaguuuaucaaacgaaugauuagccacuguacuuaccuguuggacgaauacgcccucgcuaacaauaguauccuguauucugaguucaagguuaugaacgaauuaaagcagauucgcgugaacgauagaaaacuggagcuaaaguuucagcaacagauccucgaagacuucuuuaaaaagacauccggcaccauaacggagaggaaauucaagaauuaccugauuagcaccggggaguauucgauggaaggaggcaacuuucggaucacagguuacucugccgaugggaaguucgcgaauaacaugcaguccuauguagacuucuuuggagagaauggcauuuucgcagauacugacuacaaccuugaaaaugccgaggagaucauagaauggaucaccauuuuugaggacaaagauaucuuggaaaagaaagugcgcgacaacuauucaaagcugaaugagaaccagauuaaaaagguccucgcuaaaaaguacaguggcugggggagccuguccaagaaauuacugaagacaaaauacuauaaggauaaagccacugaacuuuacaagucuaucuuggaccucauguaugagaccgauaagaauuucaugcaaauaauuaacgacgauaaauacaauuuucaggagaugaucaagaaauucaacaauaaggaagagaacaaaaagcugaacuauagcaucguggaagaacuagcaacaaguccugcuaccaagagaggaauuuaccaggcccugaaaguuguggaggaacucgucgacuauaucgguuacgagccaaagaauauuaguauagaaauggcgagguccgaggaagagaaagugcguaaggauagccggaaagacuacaucaacaaucuguauaagggcugcaaggauucuauugaaaacuacaaaaagcugaaacaugaguuggacucacacgagaucacuucacagcgacuguuuuuauauuucauucaagaagggaagugucucuacacgggaacaccccugaauaucgaggauauagaaaaccagagccuuuaugagaucgaccacauuaucccuagaucccugauuaaagacgauucuaucgacaauaaggccuugguacucaaggagugcaaccaggauaaaaaggcaucguacguucugccaagcaaauuuagaaauuccaagcagaaaaccugguggaagcaucuaaaagacaacggccugaugucagcuaagaaguuccacaaucucauacgcgaaaaauauaacgaggaagauauuaaugguuuuaucaaccggcaacugguggagacuagacagaucaccaagcaugucgccaauauucuuaacaauuuguacaaagacacaaacgugauauaccugaaggcugauuuaagucacaacuauagggaaaaauacgaccucuucaaguuucgcgauaucaaugacuaucaccaugcccacgaugcauaccuggccgcuguccuuggggaguauaaggagcgauucaugaaacggaagauuaacuucgacauggugaaagaacuuaauucuaagaucguugagauggacgaaggcaaacguagaaaccuaagguuuggauacgugauuaauagccucgaugagaaccugaaugacaucguauugaagauauccgaaaaccuggucgauaaugagaccggcgagguguuauucgacgcgcaugaauuuaacaagcgcguugaggauacucucuaucggaaugacauccugauuucaagaaaaacagaaaucaggacggggcaguucuacaaggagaccauuuacaaaaagggaaaagguacuaucccgauaaaguuuggcaugcccacagauauuuaugggggauacagcaacaccaaugcacgaaaacuuaugcugaucgaauauaacgagucuaagaugaagaucauuggcuugccuauggcccucgcugugcgcaauaacgacgccgagaucaacgauuacauaaaaacacagauuaaucugaagaaaaacuccacuuucaagaucaaaaaguguaguauuccauuugaaaccgagaucauauauaauaaccaaaaugucuucauuaaggguuacagcaucgggcacaaaaacugcgaaaucucuaaugcaauucagcuaaagaucgccaaagacaagaugaaacauuggaaguaugcucugcaguaccuucucaacgauaagaaacaauacauugacuuugccgagaaguaugugaaugagauauacgauuuccugaucaacuuggaccuguuucccuuauucaauaaagaacucgacaagauuaaaaacaagguaaauuucgaggaucuggcacuugaccagcagaagaaaaucacgaaggaacuguuuaaaauguugcacuguaacuccgugaaugcgaaccucucagaguucggccugggagaucggaugggcagacuaaguggguauaacaucaccgacggaauuauaaucagcaagucgguuacagguauuagggaaucccguuacgaguuuuga

SEQ ID NO: 2995 - RNA, 4035 nt, Artificial Sequence
  Cas9 variant
augagccagaacaauaacaagaucuacaauauuggccuggacauaggggaugccuccgugggaugggcugucguugacgagcacuauaaccuccuuaaaagacaugguaagcacauguggggcucuaggcuguucacccaagcaaauacagccguggaacggcgcucaagucgaagcacucguagaagguacaacaaacggcgcgagagaaucagguuguuacgggaaauuauggaggauaugguacuggacguggaucccacguuuuucauccgccuagcgaaugucuccuuucucgaccaggaagauaagaaagacuaucugaaggagaacuaccauucuaauuauaaccuuuucauugauaaggacuuuaaugauaaaaccuacuaugacaaguacccuacaaucuaccaucugcgaaaacacuugugcgagucgaaggaaaaagaggauccaagacucauauaucuggcucugcaccacaucgugaaguacagggggaacuuccucuaugaaggacagaaguuuucaauggacguuagcaauauugaggacaaaaugaucgauguguuacggcaguucaacgagauuaaucuguuugaauacgucgaggaccguaagaaaaucgaugaagugcuuaacguauugaaggagccgcugaguaaaaagcauaaagccgaaaaggcauucgcccuauuugacacuaccaaggauaacaaagcugcauauaaggagcucugugccgcucuggccggcaauaaauucaacguuacaaagaugcuuaaagaggcggaacugcacgacgaggaugaaaaggacauauccuuuaaguucucugaugcaaccuucgacgaugccuuuguggagaaacaacccuugcucggugacugcgucgaguucauugaccuguuacaugauaucuacagcuggguggaacugcagaauauucucggguccgcucacacuucagagccuaguaucagcgccgcaaugauccagcgcuaugaagaccacaagaacgaucuuaaacuguugaaggacgugauuagaaaauaccuaccaaagaaguacuuugaggucuucagggaugaaaaaucuaagaaaaauaacuauuguaauuacauaaaccaucccuccaagacaccuguugacgaguuuuauaaauacaucaagaagcugauugaaaagaucgaugacccagaugugaagaccauacucaauaaaauugagcuggagucauucaugcuuaagcagaacagccggacgaauggagcuguacccuaucaaaugcagcuggacgaauugaacaaaauccucgagaaucagaguguguacuauucugaucugaaggacaacgaagauaaaauccgauccauuuuaacuuuucgcaucccuuacuacuucggcccacugaauauuaccaaggacagacaguuugacuggauaaucaagaaagagggcaaggagaacgaaaggauucuaccguggaacgccaaugagaucgucgauguggacaaaacagcggaugaguucaucaagcggaugcgcaacuuuugcacuuauuuccccgacgaaccuguuauggccaaaaauagccucaccgugucgaaguacgaaguccugaacgagauuaauaaacuuagaauaaacgaucacuugaucaaaagggacaugaaggauaaaaugcugcauacacucuuuauggaccacaagucuauuuccgcaaaugcuaugaaaaaguggcuggugaagaaccaauauuucucaaauaccgaugacaucaaaauugagggguuccagaaggaaaacgccuguaguacgagccuuacuccauggaucgauuuuacaaaaauauucggaaagaucaaugaguccaacuacgacuuuauugagaaaaucauuuaugauguaaccguuuucgaagacaagaagauccugcgucggcgauugaaaaaggaauacgaccucgaugaggagaaaauaaagaaaauucugaaguuaaaauauucugguuggagcagacugucaaagaagcuacucaguggcaucaaaacuaaguacaaagacuccacaaggacccccgaaacggugcuggaggucauggaacgcaccaauaugaaccuuaugcaagugauuaaugaugagaaguugggguuuaaaaagacaaucgacgaugcuaacagcacuucugucucaggaaaguucaguuacgccgaagugcaggagcuggcaggcagcccugccauaaaacgggguaucuggcaggcucuccugauuguugacgagaucaagaaaauuaugaagcaugaaccagcgcacguguauaucgaguuugcaagaaacgaagaugagaaagagaggaaggacuccuucguaaaucagauguuaaagcuguacaaagauuaugacuuugaagaugagaccgaaaaggaggccaacaaacaccuuaagggggaagacgcuaaaucuaagauacgcucggagcgauugaagcucuacuauacacagaugggaaaaugcauguacacuggcaagagccuggacauugaucggcuagacaccuaucaagucgaucauaucgugccccagucccugcucaaagacgauucaaucgacaauaagguucuggugcuuaguucugagaaccagcguaaauuggaugaccuggucauuccgagcuccaucagaaauaagauguacggcuucugggaaaaguuauuuaacaauaaaauuauaucaccuaagaaauucuacagccucaucaagacagaguuuaacgaaaaagaucaggagagguucauuaaucgccaaaucguggaaacccggcagauuacuaagcacguagcccagaucauagacaaccauuaugagaauacgaaagugguuacagucagagcagaucugucucaccaguucagggagcgauaccacaucuauaagaaccgcgacauuaaugauuuucaucacgcccaugacgcuuacaucgccaccauucuugggacuuauaucggacaccgguucgaaucccuggacgcaaaguacauauauggugaguacaaaagaauuuuuaggaaccaaaagaauaaaggcaaggaaaugaaaaagaacaacgauggguucaucuugaauaguaugcguaacaucuacgcggacaaggauaccggagagauugugugggaccccaauuauauagaucgcaucaaaaaguguuuuuacuauaaagacugcuucgugacaaagaaacucgaagagaacaauggcaccuuuuucaacgucacuguucugccaaaugauacaaacagcgacaaggauaauacgcuagcuaccgugccugugaacaaguaccggucuaauguaaacaaauaugguggguuuuccggcgucaauucauucauuguggccaucaagggcaaaaagaaaaagggaaagaaaguuauugaggugaacaagcugacugggaucccccucauguacaaaaaugcagacgaagagauaaagaucaacuaucugaaacaggccgaagaucuugaggagguccagauuggaaaggaaaucuugaaaaaucagcugauugagaaggacgguggcuuauacuacaucguggcuccaacagaaauaauuaacgccaagcaacucauccugaacgagagucagaccaaacuuguuugugaaaucuauaaggcaaugaaauacaagaauuaugauaaccuggacagcgagaaaauuaucgaccuauacagacuccugauaaauaagauggaguuguauuaccccgaauauaggaagcagcuggugaaaaaguuugaggaucgauacgaacaauuaaaaguaauuucgaucgaggaaaagugcaacauuaucaaacagauacucgcuacacugcauuguaauuccucuauugggaagaucauguacagcgacuucaagaucucaacuaccauuggacggcuuaacggccgcacgaucagucuggaugacauuuccuucauagccgagucuccuaccgguauguauagcaaaaaguacaaauuguga

SEQ ID NO: 2996 - RNA, 4035 nt, Artificial Sequence
  Cas9 variant
augaagaaaaccaaccccuacauccugagccucgacauuggcacagccuccauaggguaugcuugcauggaucuugacuucaauauccugaaguaccacgauaaagacgcaauuggaguguugacuuuugagggugccgauacggcggcugaaagaaggggcuuccggaccucucgccgacguaagaacagaaggaucaaacgguuagggcugcuacaggagguccucgccccucugguuaagaauccaaacuauuaccaacuucugaauuugcauaaguggaaaaacucaaaugaagacuuuaagcaccgcagucucagcgaggugcugaaaauucugggaaagaacccgaaaacauaucccacuaucuaccaucuccagcaggauauacagaaucacccugaaaagaaguucgagccagaguuaaucuuucuggcacuuuaucauuugguaaaauacagaggccacuuccuguuuaacaaucuauccuucgacaaggguaaaaccguggauaacgaagcccaacucucugagcugcuugaacaguaccagucgauuaaucccuaugaggacucaaucagcaacaaggauauuaaugucaucguggacacacugaaagaugaccaguugaccaggaacgacaagaguaaagagcucaagcggaacguuuccaagacucacgcugaacuguuuaaaauguuaguggggcugaaguucaaacaaucuauacucuuugagaauauggaaaacgcagaggauauuaaggaaagcgccacaggauccgacgcuaucucacuuagugaugacuacuaugagaaucugagcgaguucuugaccgaugaacagcuaaacuuuauugagucugccaauacguucuucaugggcaucaugcuggaccgcauccucaaaggcgcgacuuccauuucagcagccaagguccgagauuacaagauauuuaaaaaccagcugaagaucauuaaagacaucguguaucagaauaaguacgauaaauaucaugaguucuuuguaaccagcaaggaggacaugagagcuuaccaagaaaacccugaugccaagacauucgggaaacuuaguaaguuugaccaguaccugauacacccaaaagaccaguaugcaaaguugaugaaagaucucaagggaauuguucccaagaaauacacugaggugcugaauuuaaucgacgagcaaaaguuccuggucgugcagaacaccacagauaaugcuucuaucccuuaucagaacaauguguuugaagccgagaacauucuaaggaaucagcaaaaauacuauccagaaaucaccgaggaaaugauugguaaggucauaaaccucaucuccuuccggauuccguacuauguuggcccccugacgaacaaaaaugggcagagcgacuuugcguggaugauccguaagucggaugagcagacucuuccuuggaacuucgacaaagugaucgauaagucuaaguccgccgagaaauuuauucgcagaaugacaucaaaguguaccuacuugcuggaagaggacguacucccaaaacauagucugcuuuaccaggaaauggaggugcugaaugaguugaacaauguccaacucaggggagaaaacgagcccaagcaccggauacaccgacuggauccuaaagugaagcaguucaucuaucauaauuuauuucagaagaaaaagaacguuacucacaaagaccugauuacacuacuccagaauagcgaacaucgcaacacccugaauaagacguccggccaaaaacuuaagguguucgguacccagaacgauucuaaguucgcaagcaaauugucaacauacaaugacaugaaggcuaucuuugggagugucgagaacaaaagacagaugauugaagaacuggugcucuggaucacuauauucgaggauaaggccauccugaaacagaagauuggagaaaaguauccaaauaucaccgagaaacaauuaaaccagauuguaaagcugaacuacuccggcuggggcaggcuuagcgaaaaauugcucacaaaggagguuaaugggcggucucugaucgaccuaauguauucaacugaaaacaauuuuauggagauaauuaccgacaaaacacugggauucgauugcuuuaucaagaacaguaauaaagugaagaacgcuaagauuagcuacaaagacgucgccgagcuccgcaccucccccgcacugaagaaagguaucuggaaugccauaaagauggugagagaaaucucugaucuuuucggcgcuccggagaaaauuaucauugaauuugcgacugaggaccaggucaaggggaagaggcaaaaaucgcguagcgaauugugggaugaccuggugaagaaaaacaauuuaaagcggaacaaaaaguucaagggacucuuugaggagcugaaagcauauccugaucuugacuucuccaaucccaagcugugguuguacauccaccagaacggcaaauguauguacacgaagaaaccaauagaucucgaacgacugaugucagacacaaauaaccagcuauaugagauugaucauauccugccuagaaccuuuguuaaggacgauaguaucaauaacaaggugcucguaauucagucugccaaccagaaaaagagcggugacaaaaugccccuggaaaucuucgacaaucacguccuugugccauuuuggaagauguuguacgagaacgaucugauuuccucaagcaaauuaucuaagcucaugaagaaagaguucaaugaccuggauaaggaaggguucauacaaaggcagcuuguugagacucgccagaucauuucccacgugagugacuuucugaccgaagaguaucccagcacaaccgucgugccuaugaaagcuaacguagugucugaacuacggagaaaguucgauaucccaaaaauuaggcaacucaaugacuggcaucacgccguugaugcauaccugaacggcuuugucuaucaggccgcucgcguguucuacccgaaggugaauuuguuugaguucaacuuuaaaugggagaagguccgagaaaaguggcggcagcugggagaguucacugaaaauaacaaaaagcgugaguuuuucuuauuuaaaagaauggaaaauuauguuaacgagcauggcgaggggaugaucuccaagcucauauucgaccuggauaauuucaaauuuaacuacucaaggaagguggaaaguacagagagcgccuucuacaagcagucggcauuuucccccaaaaauacgaccgcgcaauaugacucugauaagaacaaaacugcuaucuacaaggaaaugaaaaauaagcgcggaauugugguaagcuauacauacgucaagaaagaccaggagcuuaucgguuauggcguguucaacgaaaccguuuuugaguacgugaacaaugccgacgucgauaugaacacacgggcacugaagauugugagaaaagccuucccuaaguuggacaucaaaaaggcucaguaucucuuuucaauaaauaagggggaugcccugcuaguuaacggacacccauuccuguuugugagugcaaaagagaggauuaauggcaagcaacuugaguucgacaucaacaugcagcgacgccucaaaaaggcucugcggcccuacaauaaaaugacugaacaggaaaagguaggugucuacaaccaguuugccgagaaaguggugcaagaguaugaaaauuccuugggggcgaagaccagaaacgagaagcuggaauuaaucaggaaucaguucaacgagucugauaaaagcaaugaagcccucauucagugcauacuggagguccuuaagaugacgaaaguuuccgcugagcguucagugaagcugaaaauccgcuggggcagccagaccccuaacacauugauugacaucaauaacaaggcaaagauuauguacaacaguaucacuggacucaaacaaacccggcugaagucuauauauaaacuagccgaauccaagaaugagcuguga

SEQ ID NO: 2997 - RNA, 4035 nt, Artificial Sequence
  Cas9 variant
augaacaagaauuacuauaucggccuggacauggggaccaacagcgugggaugggccgucacagaucaggaguacaaucucauuaaacuuaaggguacucacgcuuggggcgcaagaauauuccaagaagccaaagacaagaaagggacgagggcgauccgguccucucgccgacguauggauagaaggaaguaucggauucaucuguugaaccaguuauuugcucaggagauccaggccauugacucaaccuucuuuauccgccuggcauacagugccuauugggaaguugauaagaaagacaagggaauaggcagaaauauccuauucaaaacaaagcaagaggaaagccaguuuuacaaaaaguaucccacuauuuggcaccucaggaagucccugcuugagaaccagccugaugcuuucucugaccugcgguacguguacuuggcauuucaucacaucaugaaauaucgcgguaauuuccuccaugagggggaaauuaagaccaacgagcugcagguacaacagaucgaacagcugaaucaguuucucauaaacaaauacaaggagauuuaugauaaugacguggaggaacgaacauucaucgccaaccaccaaauugaugcuuuaaaagagauccugcuuaauaagaacaccaauaaaacuacaaaggaaaaggagaucaaaaaguuguuugacuacgccgauugcgaaucgcuggagccauauauuucauguuucagcaaacuagcggucggaggcaaguuugaccucaguaaacugggcuacgaggggaacauacaguucuccgacccgucuuucgaagagaaggcaagcauccuucaggaugacuuuagacugauugccaucgcuaaggaaauguaugauuucgugauauugaacgaccuccugaaagaucaacccaauuuauccaccgccaugguucacguguacgagacgcauaggcaggaccugaagaaacucaaggauauuaucaucgacauugaugcaaacaaaggacuucagaauaacgaccggugguacuuuaagcuguucaaggauaaaaaugcuccuaagaacuauucagccuuuauccacaaaaauaguaaccagaagcguccaagcauugacgaguucaaugacgaaaucaaaaagauauugauugagcaucgcaacgaugucucucuagaaaagcaagacgaucugaaaaugcucuuugagaagguggaaaauaaaacucugcuuaagaccaucgcgauccaguccacaucaguaauuccccaccagcugcacuuggacgagcucgagaaaauaaucgauaacgccagcacuaaguacccuuuccugaguaauauuagagacaaauuaguucugcuauuuaccuucagggugccauauuacuaugguccccucaacgauaagucuccuuacuccaaugucgaacggaagcaguuugcaacagugaccccauggaacuucgacgagaucuuugaugaaaacaaaacgcgagagaaguucaugaaaaagcugacuaauaacugcacauaucuuagcggcgaaaccgugaugccgaaaaaggcuuuggccuacgaggacuaccugauuuaugaucgccucaauguccugcuuguuaacggggaguaccugucguugcaagaaaaggagaaaaucuaucauuaccucauaucuagacccaagacuacacuggaccagcugaaaaaggaauuagcuaaauggcacaaucaguccccuaucgauauuaucuucucaaacauucaugaggaaaucccauuugaggccaguagccacgcacaucuaaugaaguccuucgaccucgagaagcagaaagaggaacuggaaagguauauaacccuugccacgauuuacgcugacgauaagaaaucuuugaaggagcugcucaaaaaugaaagccuguuagacgagaaccaaaagaaugugauccugacccuucccacaaagaaaugggcgccuuugucauauaagcuccugcagaacauuguauacacugaugacuacggagugguccacaguauccuagauauaaugaaagagaccaaucagaacuuucagauggugcugcacaaugaacaauaucauuucaaggagcucaucgaacaggagaaccagaaauuuacacaagaaaagacuauugaggaccugaucgaggaaaaacuugaguccauucccagcuugacccagcggucuauccgccagacacuguuaauaauugaugacaucaucaaggcaucacaccagaagguuccagagaaaauuuucaucgaagugaccagaaauaacgaugacaagaggaaaggccaagaugguaaccagcucgcccgugacaaggagcugaaucgguuucuuacuaaccuguugaaagaugaaaaggcuaaucaguucugugacgucagucagcuccugaaggaccuagaggaaguggauaaaguaaagcugaaagggaagcauauuuaccucuauuuuaaacaacugggaauagaccuuuacacgggcaagaagaucguuuugaaccagcuguuaacaagcaccaaauaugauacugaccacauuaucccgcagucccucauuaaggaugacucucuggauaaucuugugcuggucgagcgagaagugaaccuaaaagucaagggcaaucacuacccugugcccucgagaauccaggacgagcagaaaaagcucuggcauuuccuguugcaaaagaaagccauaagcgagaagaaauaugggaaccugaccaggacauccaagaucaaauuagaagagguugaagauuuuguggcacgccagauuaauguaaucaacuacucaaaugucauuauccgggacauacucaagcugaaguacccacacaccgauauuaucuucaguaaaucucaauauccuagcuuuaucagaaagcaucuuaaaauugugaagaacagggacguuaaugacgcccaccaugcuguggaugccuaccugaacgucguguccggaaauuugcucucaacuacauucagcaaagcauauauacgcaagaaauacauccagauucaggacggugagaaggaaacguucaacauggagaccauccuggagaacuauuuuaagaauaacgaaaaucagcuaaaaauuaagacuaacugccugcgacgggaugcgcuuaucacauucaaaguagacuacuuuucuggcgaguucuaugggcaaacccgucuccccaagggaaaugaaaaccugauaccaaucacauugaaugaggauaaccccauguccgacacuucaaaauacggcgguuacaccaaucuggcucaggccuauuuauuugcagugagcuaccaggaagauggggagaugaagaaggccauucucagaguuccuuaucuguacgacacgcuuuauaaaaacgauucugacaagcuguuguccaaaguccucgauaauccaaaggcuaccaacauccagauucugaggaaaauccaccuaaaucaaaagauacgcuucaacgacggcauuuaccugcuuuauacaaaugagaaggaucggaacaaauacaagauggccuaccagaauuauaucgacaacgacuaccucuauuaccugcacugggcaaacaaacauuuggaagaguuacuggauaaucaggaaaagcagacuuuuaucuauaacaguaaaaaugaccaauucgaggugaguaaggcuaagaacaaagagauuuuucaguaccuccugcagaagaccaaagccaagguguaugauacauguaauuacaucgucaaagcgagagaaacuaacauagagauuuucgaacagcuuacccugaaggagcaaaucacgaugauuaaucaguggaucaaaaugaugagcagggacugcgaaaagguuaaguuugaugcccgauucacaaacuucucgaauuguuugcuacgccuguccaacaauauaaacccgaaagacucuauuaccaucaucuacgagagccccacuggacucuuuaagcacgaggugaaaauuuga

SEQ ID NO: 2998 - RNA, 4035 nt, Artificial Sequence
  Cas9 variant
augaagaaaaccaaccccuacauccugagccucgacauuggcacagccuccauaggguaugcuugcauggaucuugacuucaauauccugaaguaccacgauaaagacgcaauuggaguguugacuuuugagggugccgauacggcggcugaaagaaggggcuuccggaccucucgccgacguaagaacagaaggaucaaacgguuagggcugcuacaggagguccucgccccucugguuaagaauccaaacuauuaccaacuucugaauuugcauaaguggaaaaacucaaaugaagacuuuaagcaccgcagucucagcgaggugcugaaaacacugggaaagaacccgaaaacuuaucccaccauuuaccaucuccagcaggauauccagaaucacccugaaaagaaguucgagccagaguuaauauuucuggcacuuuaucauuugguaaaauacagaggccacuuccuguuuaacaaucuauccuucgacaaggguaaaacaguggauaacgaagcccaacucucugagcugcuugaacaguaccagucgaucaaucccuaugaggggucaauuuuuaacaaggacaucaaagucauuguggauacccugaaggacgaucaguugacuaggaaugacaaaagcaaggagcucaagcggaacguuaguaaaacacacgcugaacuguucaagauguuagugggacugaaauuuaagcaauccauccucuucgagaacauggaaaaugucgaggacauaaaagaaucugcaaccggcagcgaugccauuucccuuucagacgauuacuaugagaaccugagugaguuuuugacggacgaacagcuaaauuucaucgagagcgcuaacacuuucuuuaugggcauuaugcuggaucgcauccucaagggggccaccucuaucuccgcggcaaaggugcgagacuacaaaauuuucaagaaucagcugaaacuuauaaaggauaucguauaucagaacaaauacgacaaguaucaugaauuuuucguuacaucaaaggaggauaugagagccuaccaagaaaauccugacgcuaaaacuuuuggaaagcugagcaaauucgaucaguacuugauucacccaaaggaccaguaugccaaacucaugaaggaccugaaggguaucgugcccaaaaaguacaccgaggucuuaaaccugauagaugagcaaaaauuucuaguggugcagaauacaaccgacaacgcaaguauuccuuaucagaauaacgucuucgaagcugagaauauccucaggaaccagcaaaaguacuauccagaaaucacggaggaaaugauuggcaaaguuaucaaucugauuucuuuucggauaccguacuauguggggccccuuacuaacaagaacggacaguccgauuucgccuggaugauccguaaaagcgacgagcaggcguugccuuggaauuuugauaagguaauugacaagucgaaaucugccgagaaguucauccgcagaaugacauccaaauguaccuaccugcucgaagaggaugugcugccaaagcauucacuucuguaccaggaaauggaggucuugaacgagcucaauaacgugcaacugaggggcgaaaaugagcccaaacaccggauccaccgauuagacccuaagguuaagcaguuuauuuaucauaaccuguuccagaaaaagaaaaaugugacucacaaggaucuaauaacacuccugcagaacagugaacaucgcaauacccuuaacaaaacgagcggucaaaaguugaaggucuucgggacccagaaugacuccaaauuugcaucuaagcugagcacauacaacgauaugaaagcuaucuucggaucaguggagaauaagagacagaugauugaagaacucguacuguggguuacuaucuuugaggacaaagccauuuuaaagcagaagaucggcgaaaaauauccaaacauaaccgagaagcaacugaaucagaucgugaaacuuaacuacaguggcugggggagguuguccgaaaagcuccugacaaaagaggucaacggacggagccuaauugaucugauguauucuacugaaaauaacuucauggagaucauuaccgacaagacacucgguuuugacugcuucaucaaaaauucaaacaaggugaagaaugcuaaaauaaguuacaaggaugucgccgagcugcgcaccagccccgcacuuaaaaagggcauuuggaacgccaucaaaauggugagagaaauuuccaauuuguuuggggcuccggagaagaucauaaucgaguucgcgacugaggaccagguuaagggaaaaaggcaaaagucucguucggaacugugggaugacuuagugaaaaagaacaaucucaaacggaacaaggaguuuaagggccuguucgaggaaauuaaagcauauccugaucuugacuuuagcaaucccaagcugugguuguacauccaccagaacgguaaauguauguacacgaagaaaccaauugaucucgagcgacugcuauccgacacaaauaaccagcuguaugaaaucgaucauauacucccuagaaccuucguaaaggacgauucaauuaauaacaagguccuggugauccagagugccaaccagaaaaagucuggggacaaaaugccccuugagaucuuugauaaucacguuuuggugccauucuggaagaugcuguacgagaacgacuuaauuagcuccucaaaacucagcaagcugaugaagaaagaguucaaugaccuugauaaggagggcuuuauccaaaggcagcuggucgaaacucgccagauuauaucucacguguccgacuuccuaaccgaggaauaucccaguacaaccguagugccuaugaaagcuaacguugucagcgagcuccggagaaaguuugauaucccaaaaauuaggcaacugaaugacuggcaucacgccguggaugcauacuugaacggauucguguaucaggccgcucgcgucuuuuacccgaagguuaaucuguucgaguuuaacuucaaaugggaaaaggugcgagagaaguggcggcaguuaggcgaauuuacugagaauaacaaaaagcgugaguucuuucucuucaaaagaauggaaaauuaugugaacgagcauggggaaggaaugaucucuaagcugauuuucgaccuugauaauuuuaaauucaacuacuccaggaagguagagucaacagaaagugccuuuuacaagcagagcgcauucucgcccaaaaauacgaccgcgcaauaugacuccgauaagaacaaaacugcuaucuacaaggagaugaaaaauaagcgcgguauagucgugucuuauacauacguuaagaaagaccaggaacugaucggcuaugggguguuuaacgagaccgucuucgaguacgugaacaaugccgauguugacaugaacacacgggcauugaagauugugagaaaagccuuuccuaagcucgacaucaaaaagguacaguaucuguucagcauuaauaagggagauacucuacuggucaacggccacccauuucuuuucgugucagcuuacgaaaggaucaaugguaaacaacucgaguuugacauagccaugcagcgaaagauuaaacaggcacugagucccuacaacaauaugaccgaacaggagaagguggaguucuauaaccaauuugcugaaaaagucaucgaggaguuccgcaauuccaucggguugcagucucgggauagaaagguuaaccugauuaaaaauuuauucaacaauacggaaaagagcaacgacuccaugacccagucaauacucgaagugcugaagaugacaaaaguaagcgccgaaaggaguaaggagcuuaaaauccguuggaauggccagacuccuaacaccuuuauugauacaaagaacaaugcggaaauccaauacaaaucuauuacuggacugaagaccacgaagccaaaauccaucuucaaguuggccgagagcaaaaacgaacucuga

SEQ ID NO: 2999 - RNA, 4038 nt, Artificial Sequence
  Cas9 variant
augaagaaacccuacagcaucggccuggacauugggaccaacuccgugggaugggccgucguuacagaugacuauaaggugccugcuaaaaagaugaaaguacucgguaauacugauaagucucacauaaagaaaaaccuucugggcgcauuguuauucgacucagggaauacggccgaggauagaaggcugaagcggaccgcgcgccgacguuacacaagaaggcggaaccgcauccuauaucuccaggaaauuuuuagugaggaaaugggaaaaguggacgauagcuucuuucauagacuggaggacuccuuccuugucacugaagauaagaggggcgagcggcacccaaucuuugguaaucuggaggaagaggugaaauaccaugaaaacuucccgaccauuuaucacuugcgccaauaccucgcugacaaucccgagaagacagaucugcgacugguuuaucucgccuuagcacauaucauaaaguuugggggacacuuccugaucgagggcaaauuugacaccagaaacaaugaugugcagaggcuuuuccaggaauuuuuggccgucuacgacaacacuuucgaaaauucuucgcugcaggaacaaaacgugcagguagaggaaauucuaacagacaagaucucaaaaagcgcuaagaaagaucggguucucaagcuguuuccuaaugagaaaaguaacggccguuucgcagaguuccuuaagcugauuguggggaaucaggccgacuuuaagaaacacuucgaauuggaggaaaaggcuccacuccaguuuuccaaagauaucuacgaggaggagcuggaggucuuacuggcccaaauaggagacaacuaugcggaacucuuccuuucugcaaagaaacuguacgauagcauuuugcuauccgguauccugaccgugacggacgugucaacuaaggcaccccucagugcuagcaugauucagcgcuauaacgagcaucagauggaucuggcccagcuuaagcaauuuaucagacagaaacugucugacaaguacaaugaagucuucuccgauguuucaaaagacggcuaugcaggguacaucgauggaaagaccaaccaggaggcuuuuuauaaauacuugaagggccuccugaauaagauugaagguagcggguacuucuuagacaaaauagagagggaggacuuucugcggaagcaacgaacauucgauaacggaaguaucccucaccagauucaucuacaggaaaugcgcgccaucauaagaaggcaggcggaguuuuauccauuccucgccgacaaucaagaucggauugagaaaauccugacuuuucgcauccccuacuaugugggcccucuugcaagaggcaagucugacuucgcuugguuguccaggaaaagcgccgauaagauuaccccauggaacuucgacgaaaucguagauaaggagucgucuguggaggcuuuuauuaaucguaugacaaacuacgaccuguaucucccgaaucagaaaguccugcccaagcacucccuucuguacgaaaaauucaccguguauaacgaauugacgaagguuaaauacaagacugagcaggggaaaacagccuuuuucgaugcaaauaugaagcaggaaauauuugacggaguguucaaggucuaccggaaagugaccaaggauaaacucauggacuuucuggagaaggaguucgaugaauuucgaaucguagacuuaacuggucuggacaaagagaacaaggccuucaaugcuucauauggcacauaccacgaucuaagaaagauucucgacaaagauuuucuggacaacaguaagaaugagaaaauccuugaagauaucguuuugacccugacccucuucgaagacagggagaugauucgcaagcggcugaaaaacuauagcgauuuacugacgaaggagcaacuuaagaaauuggaaagaaggcauuacacaggguggggacgccucuccgcggagcugauacacggcauccgaaacaaggaaucucggaaaacuauucuagacuaucugaucgaugacgguaauagcaaccguaauuuuaugcagcucauuaacgaugacgcacugucauucaaggaggaaaucgccaaagcucaggugauaggggagaccgauaaucuuaaccaggucgugagugacaucgccggcuccccugcaauuaagaagggaaucuugcaaagccugaaaauugucgacgaguuagugaagaucaugggccaucagccagaaaauauaguuguggagauggccagagaaaaccaguucacaaaucaggggaggcgcaacucucaacagcggcucaaaggacugacugauucaauuaaggaguuugguagucagauccuuaaagagcaccccguagaaaauagccaacugcagaacgacagauuguuccucuacuaucugcagaauggcagggauauguacaccggggaggaacuagacauugauuaccugucccaguaugacaucgaucauauaaucccucaggcuuuuauuaaggacaacucuaucgauaaucgaguccucacaucgagcaaagagaaccgcggaaaguccgacgaugugccaucaaagaacguugugcggaaaaugaagaguuacuggucuaaacugcuuagcgccaaguugauuacccaaagaaaauucgacaaucugacuaaggcagaaaggggcgguuuaacggacgaugacaaggcgggguuuaucaaacgucagcucgucgagacacgccagauaaccaagcacguggcucggauucuggaugagagauuccacacugaaaccgacgagaacaauaaaaagaucaggcaaguaaaaaucgugacacuuaaguccaaccugguuucaaauuuucgaaaggaguucgaacuauauaaaguccgggaaauuaacgauuaccaucacgcccaugacgcauaucucaaugccgugaucggcaaggcucuguugggaguguacccccagcuggagccggaguuugucuauggcgauuacccucacuuccacgggcauaaagaaaacaaggccaccgccaaaaaguuuuucuacagcaauauuaugaacuucuuuaagaaagacgauguucgcacugacaagaauggagagauaaucuggaaaaaggaugaacacauuucuaacaucaaaaagguguuauccuauccccaggugaauauuguaaagaaagucgaggaacagacagguggcuucaguaaggagagcauccucccaaaagggaacucugacaagcugauaccuagaaaaacgaagaaauuuuacugggauaccaagaaguauggaggcuucgacucccccaucguggcuuacucaauucuuguuaucgccgacauugagaaagguaagaguaaaaagcugaaaacugugaaggcguuggucggggugacaaucauggaaaagaugaccuuugagagggauccaguugccuuccucgaacggaaaggcuaucgaaaugugcaagaggagaacauaauuaagcugcccaaauacagccuauuuaagcuggaaaacggaagaaaacgccuucucgcuucggcaagggagcugcagaagggcaaugaaaucguauugccuaaccaucuggggacauuacucuaucacgccaagaauauccauaaagucgacgagccaaagcaccuggauuacguggacaaacacaaggaugaguucaaagaacuucuggacguggucuccaacuuuucuaagaaguacacuuuggcugagggaaaucucgagaaaauuaaggaacuguaugcccagaacaauggcgaagaucuaaaagagcuggcaagcucauucauaaaccuucucaccuuuacggcgaucggugccccggcuaccuucaaguuuuucgacaaaaauauugaucguaagcgguacacaaguacuaccgaaauccugaacgccacauugauucaucaauccaucacuggguuauaugagaccagaauagaccugucuaaacucggaggcgauuga

SEQ ID NO: 3000 - RNA, 4038 nt, Artificial Sequence
  Cas9 variant
auggagaacuacaauaucggccuggacauugggaccacaagcgugggaugggccgucguuaacgaugcuacuaauaaggugaugagaaaagguggcaaggcacucuggggaguaaggcuuuucgaccccgccgugacggcggaagaucggcgcgcuaaacgagggacccguagaagguaugaccggcgcagagagaggauaaagcuguugcaggaugaauuuaaagacgagaucaacaaggucgauuccaauuucuuuuuaaagcuggaagagucuaaauacacaucaaaggacauuaaaaacaagacugugcuaaucaguauggaggaagagaaagccauuaagaaguauaaucaagaauacccuaccaucuaucaccuccggcagaaacugaugaacagcaaugagcagauggauauacgccuuguuuaccuggcaauccaucacauuaucaaguaucgaggcaacuucauuuacgaggguaauuccuuuucugugaacaauuugaacaucgacaauaaacucaaggaaauauuccugucgcugucagaggaugucgacgaacucgauauuagcgaggaaugcaucaacaacauuaauuacaaacaguuagccaacaucuuuaaugagcaaaguaagaacgaccugaaagugaaacuuacauccgaguugaccucuuauagccugaauaagaacuucaucuccgaauuuuguaaacuaauuauagggaauaaguucucagcuaaaaagcucuuuaaccuggagacugacaaugauguaagucuuagcuucgacggaacagauuuugaagacaaagcaggcgaucuggagucuuugcucaacgacuaccuggaaguuuuagagcagcugaaggagcucuaugauaugguguuccuuaagaaaaucuucggcggguccaaggaaaccacgauuucaggacugauggucgagagauacaaucagcauaaaaaggacuugaaacuacugaaggauacuuuuagcagugacaggaagaucuauaacaaaauauuccggucuaagaaagauauuaaggacgacaaagauaugugccucuacgaccuguauauccacaauaaacuugaaaccacagauuuucugaaggagaucaaaaaguacgugaacacugacaauuucauuaucaccgaugaagacuuuuugaaacgucucgagaacaacgaggugcugccacgcauuacauccaaggaaaaugguaaauacccguaucaguuaaacaaggaugagcuggucagcauaaucgaacaucaaggcaaacacuaccccuuccuacucaauaagaccgacgaugggauuuauaagcugguuagacuuuuggaguuuaggaucccuuacuucgugggaccacugguaucgaaagacaugucugagaacgccuggaugcuccggaaugaaggcaugcagggugugcacaucacgcccuauaacuuuaagaaagucauuaaucuggauaagacugcugagauauucaucaaacgaaugauuucccauuguacauaccuucuggacgaagaggccuugccuaacaauucaauccucuauagugaauuuaaggugcugaacgaguuaaagcagauuaaaguuaauggggagcaccugaccaaggaugaacagcauaaaaucauagaggaacuauucaugaagacuagcggaacaaucaccgagaacaaauuucgcgaguuccuccugaauacgcuugacuacaacuucuacgaaaaugaguugaagauuaccggcuauuccgcggacugcaaguuugcaaacaacaugcaaucuuacaucgauuucuuuggcgaaaaugggauuuucgagggaacaagcuauaacacuaaugacgccgaaaagaucauagaguggauuaccaucuuugaugacaaggauauucugaaaagaaagguggaaaacgaguacccagagcucaaaucaaaucaggucaagaacauccugaauaagaaauauagugguuggggcagguuaucccggaagcugcuuuuggaccuccgcgugcuggauaaagaaacagacauacccaagagcaucauggaucuaauguacgagacugacgaaaacuucaugcagauuaucaauaacgauaaauauaauuuucaaaagcugauugcuaaagagaacaagaucgagaauaccucuaacgaccucucauacgauguaguugaaaaucuggccacaaguccugcaaccaagagagggauauaccaggcucuuaaaguggucaaggagauuacuacguauaugggauacgaaccgaaaaacaucaugguggagauggccaggggcgacgaaaagaaaauccguaaggacgaucggaagaaauauuugcagaagcuguacgacaacauuaaagaugaggucgacagcaauuauaagaacuuaaagaaggagcucgcgaaggaagagaaaaucgauacagacaagcuguaccuuuauuaccugcaggaagguaaauguuuguacugcgggaagccgauuaauguggaugaccucaacaccaaaaauucccuguaugagauagaucacauccuaccccgaacucugauuaaggacaacucuugggauaauagaguucucguguguaggggcugcaaccaaaagaaagccgcaucgcugguacuuccuaaggaguuccgcaaugacuacaccaaaagcaucuggauucgguugaagaacaauaaacugauguccaacaagaaguuuuauaauuuaacaagaaaaucauacagugaagaggacaucaagggauucauaaacaggcagcucgucgaaacccgccagaucacuaaacacguggcuaauauucugaacuguuuuuauccaaagacaaaaaucguuuaccuuaaggccaauauuucucauagcuaucgagauaaauacgaccuguucaaguuucgggauaucaacgacuaccaccaugcucacgaugccuaucuagcagccacgcucggcuccuaccaggagaaguaucugcauuacgacuuggauuauaacaaaauaaaugaguucaacgaaaagcugauuaaaaaugaagacuacaagcguuuacacuaugggaucguggucaacucacucgaugaggaguuccaaagcgcuuuugcggaaaucgcacccagacugauuaaugaggaaaccggagagcuucuguucaacgccaaaaaguuuaaugacuugguggaggauacucucuacaggaacgacauacugaucucucgcaagacagaaauucggaccgguaaacuauacaaggagacaaucuauaaaagaggcaaggggaauauuaaaaucaaggaaaacaugccuacugagaccuacggaggcuauuccaauauggaaacgaguuaccugacccuuguaaaguaugguaacaaaacaaagcucauagggaucccaaugagcauugcuaauaacaaagaugugaagguuaaacuggacuucaucaaggagcacuuggaccugaagucuuuagauaauauugucauccucaaagacaacauacccuacgauguguccauuaacuauaagaaucaggacguguacgucaaaggcuacucaacugccaacaagaauugcgagcugaguaacgcacaucagcuuaaaaucaagaaagauaugaugaagaaguguaaauauguucugaauaagguguacaaaaacaaguaugacgauaucaccaauauggacauugaaaacgccaucacauuuauaaauuacuuguucgagauuaaaaucgaauuuccacucuucagcaaggagauuacuaagauccaggauaacauaaaucugaccgaaugcucguuugagcaacuagcuaacauuaucaaacagcugcuuaucauuuaucacugcaauuccaagaacggaaaucucaaagaguucggccugucugacaggaucgggcgauugagcggagccaacgugacggguggcgauuuuauuuucacaucaguaaccggguuaaaggagaaaacugcaaguuacgacggagaauga

SEQ ID NO: 3001 - RNA, 4038 nt, Artificial Sequence
  Cas9 variant
augguggagaaguacggcaucgggcuggacauuggaaccagcacacucgguuggacuuccgucgaugaaaacggcaaaauacagagacuuaaggggcaaacggcccugggaaccagguuguucaaugagggccagacagcugaagaacggcgcgguuuucgaacuacccguagaaggauccagcggcgcagauggagguuacggcugcuacgcgaaauuuucgacgagcccaucgggucuguugaugcaggauuuuucgcccgacagaaaaugucaagucucagcccucaagacgauagauuugaggacacauauaggcuguucaacaaucagaccgauaaggcguuucacgacgaauacccaacuacauaucaucuucggcaggcucugaugaacuccgaucgucaguucgacauucgcgagaucuacuuggccauacaccauaucgugaaauauagaggcaauuuucucaggucuggcaagccggcagauuucaagaccgggaaacuggaccugaaggaaaaauuugaggagauuaacgccgauuggcaaacgcucaucucggaagacgcuccccaguuaccuguagacgaucugacuaccauuaaggcagugcuugucgacggaucacggagccgaagugaucgccagagagguuuggugaaacuguggauggccaaugagacaguugaaaagaacuggaagccagugaugacugagcuagcuaaagccauccucggccugaagaccaaacuuuaccuguugacagggcucgaccugcccaaggaagaucagaaagcguggaccuucuccuuagacacgcuggaggaucaccaaggagacauagauagcuuuuucgacgaucaugcacagcagcucauugacaggcuugccgagcugcgggcuaugauccaauugacugaaauuaucccuucuggccuaaauuucucccagucaaugguccagcgcuaugaggcccacagaagucaccuggaaauguacaagcaguacgcacucgaccaaacagauccaaaaaggaccaaggcucugcgugccgcguauaacgccuacaucgaccagcaugagauugcagaugacuuuuauacugcugugaagcggguaacaaaagaugaccagagcgaaaccgccgaggagauaaaucgacuuaucggucuggaacaguucaugcccaagcaaagaacgaaagagaacgggguuauuccuuaccaggugcaccagcaggaauuggaucaaaucauagcucaucagaagaaauauuacccauuucucggaaccgagaauccggucauugaccacagggaaucucagcccuauaugcuggaugaguuaguguccuuccgcgugccuuacuacgucggcccaaugguugccgcaaaccccgagcugaagacaacugaaaauccuuuugccuggaugauccggaaggcucagggcgagaucaccccauggaacuucgacgaaaaaguggauagaaaggggucagcgacagcauuuauugagaggaugaaaacuaccgacacauaucuacucggagaggauguacugccccaacagagccuuuuguaccagcgcuucauggugcugaacgaacucaauaacauccgaauugacgacgagcugcuuaccacuaaucaaaagcagugggucuuugaucggguguucaaagguaagggcacgauaagugccaagcacuugcaggacgcuuugaaacaucacggggaaacagauggacucccgaagaucucuggccuggccgacccuaccaaauuuaacuccgcauuaacuagcuaucgugauuuccagaaguggcugcccaaugacauugauagaaaagacaggaccgccgauaucgagacaaucauuaacuggucgaccguuuuugaagacacucauauauucguggagaagcuaaaggagaucgaauggcucacagcugaucaacgccggagaauugccucuaauagguaccgagguugggggcgccuguccaaacaccuuuugacggagaucaaggacgaacagggccugucaauuauggaucagcucuggcggacccagcauaacuucaugcaaaucguccacgagccagacuaugcaaaacagauagaagcggcuaauacugugggaauggccaagcaggacaucggcacaguaauuaacgaucuguacaccaguccucagaauaaaaaggcaaucagacaaguuuuagccguggucaaagacauucagaacgcucaccaugggguggcccccagcuggaucuuuauggaggcagcuaggggagccgaucagaauccacaacguucccgccagcggcagagacagcugcaagaccuuuaugcgaagacagccgcugauuuggucgacacugaggugcagcaggaacucaccgauaagauaaaagacaaggcaaacuucacggauaggcugaugcuauacuuucugcagaauggucaagacauguacucuaaagagaagcucaacauugaucgacugagcgaauaugacaucgaccacauucuuccccaggccuugaucaaagaugacucacuggauaaccggguuuuagugcaucagaguauaaaucgcaacaaguccgacaccuucgcuagcgagaaguacggcgccaaaaugcagggggcauggcaccaauggagagcggccggacucaucucugcuaggaagcugcggaaucuugaaaugcgaccugaugagauuucaaaauaugccacaggcuuuaucagacgccagcugguagagacuaggcaggucauuaaguuggugaccgaaauccucagucaccaguacaacccagaggaaacaaaacugguuagcgugaaggcaggucuaucccaugagcugcgucgggaggcugggcucccgaagcugagagaccuuaaugauuaucaccaugccauagacgcauacuuggccgcuaggauuggcacuuaucuguuaaaacgcuacccccgacucgaaagauucuuugucuacggacaauuccagaccucucggcuggaucuuaggcgcuuuaacuucauccacgaccuggugaagucgaaacagggcguaaucguggauagcgacacgggggagauucuaugggaucgucaaaaggacaucgacuauauuaaacaucucaugggacugaagcacuugcugguuacacacgaagucuacgauuccgcggccgagauguaugcacagaccauauuuaaggcuucagacaaugauaguaaaguguuaaucccuacuaagaacgacagaccaacagccauuuacgguggcuauaccaaacggaggaauggguaccucgccauccugaagauuacugagaaaaaggcugagaccuaucgcguggucggaguucccacacuuuacaugucucagcuggcaacggcccgaagccauuccguggaggcggaaaaagcucugcucaagucacugauggccccugagauccuaagcgaaucuaaggugguauccuucgaggucgugguuagucacgugcaucugaaccagcuugucagagauaccguguuuggcccagcacacuacuucggucucgggcccuuccgguauguuaggaauuuucaucaacugguguugccguucaaagaccaggaaauacugguaaagcgcacuccuacagaugaggaguuaaacaccgucuuugaagacaucugcuggcaaguggagaauuacuucgccguguuugauauuaacggcuucagaaaugcucucaaaaagagcaucgacaaauuugaacagcugccaauugagaacgucuucaaggauaagaaacuuguuacacagggaaagaaagaagugcuggcauuuguaaugcagggcuugcacgccaacgcgucuuauaggaaucucaaggugucccuggggaucaaaacuccccuaggacagcugcagcuuaccaaguucaugcucucacgggacgcugagcugauagaugagaguccuacgggcuuguuucgucgcauucgaagauuaaaggaccuguga

SEQ ID NO: 3002 - RNA, 4038 nt, Artificial Sequence
  Cas9 variant
augggcaacaagcugagaaauguggacgauuacuaucucgggcuugacaucggaaccgagagcgucgguugggccguuacagauaaauacuaugugauucccaaguucaaaggcaacgcuauguggggaguacaccuguuugacgaaggggagacuuccgugaagaggcggggcuuccgcucugcacgacguagaacgcagaggaaacgggaacgcuuggccuuacuggaggcgcuauuugaugaagagauaugcaagaaggacuguaccuucuuuagaaggcuccaugagucagaucuguggccugaagacaaaaguggugaugacaaguacgcugucuucgccgaugagaauuauacagacaaagauuuucacaaggaauacccaacuaucuaucaucuucgguacgagcugauuaaaaacaaggagccgcacgacgugaaguugguuuuccucgcacugcaucacaucauuaaaaaucgcgggcacuuucuguucgacagccucuccucugccgaagauuuuaacucggcuuacgagaccaugugcucauauuuaagcgacaaugaaauccaacugaacuguagugauauagagcaguucaaggcaauccuuaaagaccgaagacagggaaagauugaaaagacaaagaauuuggccucccuguuuggcaucaccaaaaagucugaucccgugagcuacgcugucauggccgugcuauccggcucaacuguaaagaugugcgaccucuucggggaugacgagcugaaaacaguugagaagaacaauauuaguuucgcgagcggauaugaagagaacgaagagaucuacgcaucugugcuuggugauagguuugaacuggucaaaauauugaaggccguguaugacugggcugugcucgccgauauucuggacggcaaaaaguacaucuccgaggcaaaggucgcuguuuaugagaaacauaagaaugacuuaaaaacccugaagaaauacgugaagacguaccucccugaaaaguauaacgagauuuucaaaaucucagaugggaagaaagacaauuacguagccuauagcggacacaucaaggaaaguggcaaaacuggugagcuuaagaagaccuguaacucugaaaacuuuugcgcguaccugaaaaagacauuggggaaaaaugccgaucuauccuauaaggagauguucgacgagauugaaaacaaaacuuuuaugccaaaacaggugaccaaaagcaauggagucgugcccaugcaaguuaacgaggaagaacugaaggcaauacucgauaaugcuaaggacuaccugucguuccuuaacucuugugaugagaauggcguguccgucuaugacaaaaucauuaagaucuuugaauaccggauaccuuacuaugugggcccacugaacacacauaccgaaaauucaugguugaaacguaaggaugggguaaaaauuuaccccuggaacuucgacgauguuguggacaucgauaguagcgccgaaaaguuuaucaauaaccucacguccaagugcacuuaucugccugagugugacgucauuccaaaaugcucuuuacuguacagcaaguucacagugcuaaaugaaaucaacaaucucaaacugaacggagaggacauuccggucgagcuuaagcaggguauauauaaagauuuguuuaugacccgcagaaaggugacuguuaagcagaucaaagacuaccugaaggcuaggggcuguuaugauaacaaugacgugcucucagggauugauacaaccguaaaaaguucccuuaagagcuacuucgacuuuaaaggauucgaaucucugacguucgaugacaaggagucaaucaucgccaguagcgucauuuuuggcgaugacaagaaacuguugaagaaacggcucaagaaacuguuccccgaaaaguuaaccgaugaggacauaaagaagaucugcaagcugaaauacacagguuggucccgacuaucuaaggaauuucucugcgauguggaguucacuuauaaaaagaccggggagguuaugaacgugauuacagcacugugggaaacuaauuacaaccuuaugcagaucuuguauucggaggacuuuuguugcgacggcgaugagaaaaagaaucugaacgacaagcucgaugagcugagcuacaccggagaccaacacuccuuacgcaaagccgucgaugcucuguaugugucaccuaagguaaaaagaccaauucuuagggcguugcucaucgcaaaggaaauagagaaaauccaggagcggcccccuaagaagauuuucguggaaguugcccgcggcaucgacaauagagaggaaaggcaccgugauagucggaaaaaccgacugauggagcuauacaagaauuguaaaaaggaggcugaaaaauuuugcccauauuucgacgcccugucuaagaagcucagcgaugaggacgaauccaaacugagaagggauaaacuuuacuuuuacuauauucaguuggggaaauguauguacacaggagaggaaaucucacugggugaguuaaugaacggcaaugggcgcuucgacauagaccauauuuauccccggagcaagaucaaagaugacucucucaccaacaagguccuggugaauaagacugugaacaauaacaaaacgaacgucuacccgauugaugcagccauccaguccaagaugaguccuuauuggcaaaugcuuagaagcucuggacugauauccgaggaaacauacaaaagguugacccgcaagacuccccucaccgacgaugagcugucagcuuuuguuagucgacagcuaacagaaacccagcaaagcacuaaagccguggcacacauccuggagcagcucuauccaaagccuaaaacagaaauuguguacguaaaggcggcucugguccaugccuuccggcagucgaaugacaugcuuaagugccgugaggugaacgauuugcaccaugcaaaagacgccuaccugaauaucguugugggcaacgcuuauaaugucaaggugacgcacaacaaaguuaauuuuauuaaggguuuacagaacaaugauaaaggguacaccgugaaccccgagaaguucuucucccacgacaucccaggcgccuggucuguaaaggauagcaugaauacugucagaagguuuaugaacaaaaauaacauacgcuauacacgguuccccagaaagaaacaaggaggccucuuuaagauuaauccucugaaaaaggggaacggacaggugccacuuaaggcaucaggugcuaggaguuguaucgaaaaauacggcggguaugacaaggccaccuccgcguacuucucuuauguggaguacacagauaaaaagggaaaagccguccgacagauguuuccgguuaaccuguacgaagugaaggaguaugaagcugacaugcagggcuucguaacuagccgcaucgcagaggccuccaaugugaagauucuaauccccugcgucaaauacgacgcuuguauuucauuugaugguugccggauguucauaaccaagaaaacggggaacagaaucggcuauaagccuggaaugcaacucgugcugggcuacaaauaugagaaguacauuaggaauaucgaaaacuauuugaccaaacauaaggaccgugagauuaucccacgcgauaauauaagcgccgaagagaacaucgagcuguacgacauuuuaacagggaagaugcucaauacuguucugagugugaaauuuucuggaaucggcaagaaacuugaaaagcggagagagaaauucguccuguguucccccgaggagcagugcugcguguugaacgaaauucucaagauccugcacgcaaauguucuaagcggugaucugucgcuuauaggggagucaccuaacaccggaacaaugaagacuaaugcgaaauuuucugagauuaaggacgugcauaguaucaaacucaucaaccaguccgucaccggccuguucgaacaggagauugauuugcugaaguga

SEQ ID NO: 3003 - RNA, 4038 nt, Artificial Sequence
  Cas9 variant
augggcaagcccuacagcaucgggcuggacauuggaaccaacuccguggguugggccgucguuacagaugacuauaaagugccugcuaagaaaaugaagguacucggcaauacugauaaacagucuauaaagaagaaccuucugggggcauuguuauucgacucaggagagacggccgaagcgaccagacugaaaaggacagcucggcgccgauacacucguagaaagaauaggcuacgguaucuccaagagaucuuuaccggcgaaaugaacaaaguggaugagaauuucuuucagcgccuggacgauaguuuccuugucgacgaagauaagagaggugagcaccauccaauuuuugggaacaucgccgcagaggugaaauaccacgacgauuucccgacaauuuaucaucugaggcggcacuuggccgacaccagcaagaaggcugaucuccgccugguuuaccuggcacucgcccauaugaucaaauuucgaggacacuucuuauaugaaggcgaccugaaggcugagaauacugacgugcaggcccuuuuuaaagauuucgucgaagaguacgacaagacaauagaggaaucccacuugucugagaucaccguggaugcgcugucgauucuaacggaaaaaguaucaaagagcaguagacucgagaaccugaucgcacauuaccccacugaaaagaaaaauacccuuuuuggcaaccugauugccuugucccucgaccugcacccuaauuucaagacaaacuuucaguuaucugaggaugcuaaacugcaauucagcaaggacacuuaugaggaagaucucgagggguuccuuggagaaguuggugacgaguacgccgaucuguuugcauccgcuaaaaauuuguaugacgccauccuacugucaggcauacucaccguggaugacaacaguacaaaggcgccacugagcgccucuauggucaaaagguacgaagaacaucagaaggaccuuaagaaacugaaggauuucauuaaagugaaugcacccgaccaguauaacgcuaucuuuaaggauaaaaacaagaagggguacgccuccuauauugagucaggagugaaacaggacgaauuuuacaaguacuugaaaggcauccuccugaagaucaaugguagcggggauuucuuagacaaaauugaucgggaggacuuccugcguaagcaacgcaccuuugauaacggaaguauaccucaccagauccaccuacaggaaaugcaugcuauucucagaaggcagggcgagcacuauccauuccugaaggaaaaucaagacaaaaucgagaagauacuuacguuucggauucccuacuaugucggcccuuuggcccgaaaagggucucgcuucgcaugggccgaguacaaggcugaugaaaagaucacuccauggaacuuugacgauauccuggacaaagagaaauccgcggaaaaguucauuacaagaaugacccucaaugaccuguaucuuccggaggagaagguucugcccaaacauagcccuuuguacgaagcauuuacuguguauaacgagcucacaaagguaaaauacgugaaugaacagggagaggccaaguucuucgauaccaacaugaaacaggaaaucuuugaccacgucuucaaggagaauaggaaggugacgaaagauaagcuguuaaacuaccugaauaaagaguuugaagaguuccggauuguuaaccuaaccggucucgacaaggaaaauaaggcuuuuaacucgucucugggcacauaucaugaucuucgcaaaauauuggacaaguccuuccuggaugacaaagccaaugagaagacuaucgaagauauuauccaaacccucacacuguuugaggacagagagaugaucaggcagcguuuacagaaauacucagauauuuucacuaaggcacagcugaaaaaguuggaacggcgacacuauaccggguggggaagacuuaguuacaagcucauaaacggcaucaggaacaaagagaauaagaaaacaauucuggacuaucuaaucgaugacgguuacgccaaccgcaauuuuaugcaacugauuaacgacgaugcucucagcuucaaggaagagaucgcccgggcacagauaaucgacgauguggacgauauugcgaaugucgugcacgaccugccagggucccccgcuaucaaaaagggcauucuucagucuguaaaaaucguugaugaauuggugaaggucaugggacauaacccugccaauauaauuaucgagauggcaagagagaaccagaccacugacaagggcaggcgcaauagccaacagcgacugaaauuacuccaggauucacugaagaaccuugacaauccagugaacauuaaaaaugucgaaaaccagcaacugcagaaugaucgguuguuucucuauuacauccagaacgggaaggacauguacacgggagagacacuggacauaaacaaucuaagucaguaugauaucgaccacauuaucccccaagccuucauuaaagauaacucccuggacaaucgugugcucaccagaagcgauaagaacagggguaagucugacgauguuccgucaaucgaagugguacaugagaugaaaaguuuuuggagcaagcugcuuuccgucaaauugauaacucagcgcaaguucgacaaucugaccaaagcugagcggggcggguuaacagaagaggauaaggccggauucauuaagagacagcucguggaaaccaggcaaaucacuaaacacguugcacagauccuggacgagcgauuuaacacagaguucgauggcaauaagcgccggauuagaaacgugaaaaucauuacgcuuaagucuaaucuggucucgaacuuuaggaaagaguucgagcuauacaaggugcgugaaauaaaugacuaucaccaugcucacgaugccuaccucaacgcgguaguggguaaugcccuguugcugaaguauccucaguuagagcccgaauuuguuuacggggaguauccaaaauacaacagcuaccgcucccggaagucagcuaccgaaaaauuccucuuuuauaguaauauccugagauucuuuaagaaagaggacauucagacuaacgaggacggcgaaaucgcauggaacaaggagaagcauauuaaaauccuuaggaagguccugucuuacccucaagugaauauagugaaaaagacagaggaacagaccggaggcuucagcaaagaauccaucuugcccaagggggagucagauaaacucauuccacgaaagacaaagaacagcuauugggaccccaaaaaguacggagguuuugauucuccugucguugccuauuccauccugguguucgcugacguggagaaaggcaagaguaaaaagcuacggaagguacaggauauggucgggauuacuaucauggaaaagaaacgcuucgagaaaaauccaguggacuuucuggaacagagaggauacaggaacguucggcuugagaagauaauuaaacucccgaaguauagccuguucgaguuggaaaauaagcgaagacgccuguuagccucugcaaaagagcuccaaaagggcaacgaacuggugaucccccagagguuuaccacgcuucuguaccacuccuaccguaucgagaaagauuaugaaccugagcaucgggaguacgucgaaaagcacaaagacgaguucaaggaauugcucgaguauauuucaguguuuaguagaaaguacguucuggcggauaauaaccuaaccaaaauagaaaugcuguucagcaagaauaaagacgccgaggugucgucccuugcuaagucuuuuaucagccuccugacauucacugccuuuggugcaccagcugccuucaacuuuuucggggagaauauugauaggaaacgcuauaccucaguaacagaaugcuugaacgcaacuuuaauccaccagaguauuaccggccuguacgagacgcgaaucgaccucuccaagcugggagaagauuga

SEQ ID NO: 3004 - RNA, 4038 nt, Artificial Sequence
  Cas9 variant
auggaccagaaguacagcaucggccuggauauugggaccaacuccgugggaugggccgucguuacagacgauuauaaagugcccgcuaagaaaaugaagguacucgguaauacugacaaacaaucuauaaagaagaaccuucugggcgcauuguuauucgauucaggggagacggccgaagcgaccagacugaaaaggacagcucggcgccgauacacucguagaaggaaucggcuacgcuaucuccaggagaucuuugccgaagagaugaacaagguggacgaaaauuucuuucagagacuggaugacaguuuccuugucgaugaggacaaaaggggagagcggcacccuauuuuuggcaacaucgcagccgaagugaaguaccaugaugacuucccaaccauuuaucaccuucgcaaacauuuggcugauaucagccagaaggcagaccuccgacugguuuaccuggcccucgcucacaugauaaaguuuagaggucauuucuuaaucgaggggcaacugaaagccgaaaauacaaacgugcaggcgcuuuuuaaggacuucgucgagguguaugauaaaaccguagaggaaucccacuugucugagaugacuguugacgcacugucgauucuaacagaaaaggugucaaaaagcaggcggcucgagaaucugaucgcccacuacccggcugaaaagaaaaacacccuuuuuggaaaucugauugccuugagucucggccugcagcccaacuucaagacgaauuuucaguuauccgaggaugcaaagcugcaauucucuaaagacacuuacgaggaagaucucgagggccuucugggggaaaucggagacgaguaugcugauuuguucgccagcgcgaagaaccuauacgacgccauacugcucuccgguauucugaccgucgaugacaauucaacaaaagcaccucuuagugcuagcauggugaagcguuaugaagaacaucagaaagaucugaagaaguugaaagacuuuaucaaggugaacgccccagaccaguacaacgcuauuuucaaagauaagaauaaaaagggcuaugccggguacaucgagaacggagucaagcaggacgaauuuuauaaauaccucaagggcauccuguuacaaauuaaugguucuggggauuuccuggacaaaauagaucgcgaggacuuucuaagaaagcagaggacuuucgauaacggauccaucccccaccagauucaucuccaagaaaugcacgcaauccugcggcgacaggaggaacacuacccuuuucuuaaagagaaucaggacaagauagagaagauuuugaccuuccgcaucccauauuacguuggcccccuggccagaaaaggcucaagguuugcuugggcggaauauaaggcagaugagaaaaucacaccuuggaacuucgacgauauucucgacaaggagaaaagcgccgagaaguuuaucacccggaugacgcugaaugaucuuuaccugccagaggaaaaaguguugccgaagcauagucuccuguaugagacuuucacaguauacaacgaauuaaccaaggugaaauaugucaaugagcagggggaagcuaaguuuuucgacgccaacaugaaacaagagauuuucgaccacguguuuaaggagaaucgcaaaguuacuaaggauaagcugcuaaacuaccucaauaaagaguucgaagaauuuagaauagugaaccugacaggacuugacaaggagaauaaagcauucaacucuuccuuggguaccuaccaugaucugaggaagauccucgacaagagcuuucuggaugacaaagccaacgaaaagacgauugaggauaucauccagaccuuaacacuguucgaggaccgugaaaugauucggcagcgacuucagaaauauucggauauauuuacuaaggcucaauugaaaaagcucgagagaaggcacuacaccggcugggggcgccugucuuauaaacuaaucaauggcauucggaacaaggaaaauaagaaaacaauccuggacuaccucauugaugacggauaugccaacagaaauuucaugcagcugaucaacgaugacgcacuuuccuuuaaggaggaaauagcgagggcucagaucauuggugacgucgaugacaucgccaaugugguacaugauuugcccgggagcccugcaauuaaaaagggcauccugcagaguguuaaaauaguggacgaguuagucaaggugaugggacacaacccagccaauauuaucauugagauggcucgcgaaaaccaaaugacugauaaaggccgacggaauagccagcagcgucucaagcugcuucaggacucccugaagaacuuggauaaucccgucaacaucaaaaauguggagaaccaacagcuccagaacgacagacuguuccuauacuauauacaaaaugggaaggauauguacaccggagaaacacuggacaucaacaaucucucucaguacgauauugaccacaucauuccucaggccuuuaucaaagacaacagccuggauaauaggguucuuacccgcucagacaagaaccgggguaaaagugaugacgugccauccauagagguaguccaugagaugaagucauucuggucuaaguugcugucagugaaauuaauuacucagagaaaguuugauaaucucacgaaagcagaaaggggcgggcugacagaggaagacaaggcuggauucaucaaacgacaacuuguugagacccgccagaucacuaagcacguggcccagauucuggaugaacgguucaacaccgaguuugacggcaauaagagaaggauccguaacgucaaaauuauaacacuaaagaguaaucucgugagcaacuuccgcaaagaguuugaacuguauaagguacgggagaucaaugauuaccaucacgcgcacgacgccuauuugaacgcugugguugguaaugcacuguuacucaaauacccccagcuggaaccggaguucgucuauggggaauacccuaaguauaacuccuacagaucuaggaagucggccaccgagaaauuucuuuucuacagcaacauucugcgauuuuucaagaaagaggauauccaaacuaaugaagacggcgagauugcuuggaacaaggaaaaacauaucaagauauugcggaaggugcucuccuauccccaggugaauaucgucaaaaagacagaggaacagacgggaggcuuuucaaaagagaguauucugccaaagggggagucugauaaacuaaucccucgcaagaccaaaaacagcuacuggaaucccaagaaguauggagguuucgacuccccaguuguggccuacucaauucugguguuugcagacguagaaaaaggcaagagcaaaaagcugagaaaaguccaggauaugguggggaucacuauaauggagaagaagagguucgaaaaacaccccguugacuuccucgagcaacggggauaucgaaacgugagacuggagaagauuaucaaauugccuaaguacucucuguuugaauuagagaauaaacgcaggcgucuccuggcguccgcccgggaacuucagaagggcaacgagcuggucaucccacagagauucacaaccuugcucuaucauaguuaccaaauugaaaagaauuacgagccggagcacagggaauauguggagaaacauaaggaugaauuuaaagagcugcuagaauacauaagcguuuucucucgcaaguaugugcuggcugacaacaaucuuacaaaaaucgagaugcucuuuuccaagaacaaggaugccgagguaucaagucuggcaaagagcuucauuucguuguuaacuuuuaccgcuuucggugcccccgcagccuuuaauuucuuuggggaaaacaucgaccgaaaaagauacacguccgucaccgagugccugaaugcuacacucauucaccagucuaucacuggccuguaugaaacccggauagaucuuagcaaacugggagaggacuga

SEQ ID NO: 3005 - RNA, 4038 nt, Artificial Sequence
  Cas9 variant
augaagaaagaguacagcaucggccuggacauugggaccaacuccgugggaugggccgucauaacagaugacuauaagguucccgcuaaaaagaugaaagugcucgguaauacugauaagcagucuaucaagaaaaaccuucugggcgcauuguuauucgacucaggggaaacggccgaggcgaccagacugaagaggacagcucggcgccgauacacucguagaaagaauaggcuacgguaucuccaagaaauuuuuaccgaggaaaugaacaagguagaugagaauuucuuucagcgccuggacgauaguuuccuuguggaggaagacaaacagggaagcaaguacccuaucuuuggcacacugaaggaggaaaaagaguaucacaagaaauucaagaccauuuaccauuugagagaggaacucgccaacuccaaagagaaggcagaucugaggcuggucuaucucgccuuagcucacaugaucaaauuucggggucauuuccuguacgaaggggaccuuaaggcagagaauacugaugugcaggccuuguuuaaggacuucguugaagaguacgauaaaacaauagaggaaucucaccugucggagaucaccguggacgcucuaucaauucucacggaaaaggucagcaaaaguucccgccuggagaaccuuaucgcccauuauccaacugaaaagaaaaauacccuguuuggaaacuugauugcgcucucucugggcuuacaaccgaauuucaagacaaacuuucagcugagcgaggacgcaaagcuccaguucuccaaagauacuuacgaggaagaccuugaggaacuguugggcgagaucggggaugaauaugccgaccuauucgcuucagccaagaaucuguacgaugcaauacuccugagugguauucuugcuguggacgauaacaccacaaaagcgccccugagcgccucuaugguaaagcgauaugaggagcaccagaaagacuugaagaagcucaaagauuuuaucaagguuaaugccccugaccaauacaacgcaauuuucaaagauaagaacaaaaagggauaugcuggcuacaucgaauccgggguggagcaggacgaauuuuacaaguaucugaaaggaaucuuacugaagauuaauggcucaggugacuuccuagauaaaauagacugcgaggauuuucucagaaagcagaggaccuucgacaacgggagcaucccacaccagauucaucugcaagagaugcacgccauccuucggcgucagggagaacauuaccccuuuuugaaagagaaucaggauaagauagagaaaauucugacguuccgcaucccuuauuacgucggcccacucgcuagaaagggcaguagguuugccugggcagaauauaaggccgacgagaaaaucacucccuggaacuucgaugacauucuggauaaggaaaaaucugcugagaaguuuaucacacggaugacccuuaaugaccuguacuugccugaagagaaagugcucccaaagcacuccccgcuguaugaaacuuucacaguguacaacgaguuaaccaaggucaaauacguuaaugaacaaggggaggcgaaguuuuucgauacgaacaugaaacaggagauuuucgaccacguguuuaaggaaaaucgaaaaguaaccaaggauaagcugcuaaacuaucucaauaaagaguucgaagaguuucgcauagugaaccugacaggacuugacaaggaaaauaaagcauucaacagcucguuggguacuuaccaugaccugagaaagauccucgauaaaucuuuucuggacgauaaggccaaugagaagaccauugaggacaucauccagacauuaacucuguucgaagauagggagaugauucggcagcgccuucaaaaauauuccgacauauuuaccaaggcucaguugaaaaagcucgaaagaaggcacuacacaggcugggggcgucugucauauaaacuaaucaacggcauucggaacaaggagaauaaaaagaccauccuggauuaccucauugacgauggauaugccaaccgaaauuucaugcagcugaucaacgacgaugcacuuaguuuuaaggaggaaauagccagagcucagaucauuggugacgucgaugacaucgccaaugugguucaugacuugcccgggagcccugcaauuaaaaagggcauccugcaauccgugaaaauagucgaugaguuagugaagguaaugggacacaacccagcgaauauuaucauugaaauggcuagggagaaccagacuacggacaaaggccgccguaauucucagcagagacucaagcugcuucaagauagccugaagaacuuggacaaucccguuaacaucaaaaauguggaaaaccagcagcuccagaaugauaggcuguuccuauacuacauacaaaacgggaaggacauguauacaggagagacccuggauaucaacaaucucucacaguacgacauugaucauaucauuccucaggccuuuaucaaagacaacagucuggauaaucgcguccuuacucgauccgacaagaaccgggguaaaagcgacgaugugccaucuauagaggucgugcacgaaaugaagucauucuggaguaaguugcugagcguuaaauuaauuacccaacguaaguuugacaaucucacaaaagcagagagaggcgggcugaccgaagaggauaaggccggauucaucaaaaggcagcuuguggaaacucgccagaucacaaagcacguagcucagauucuggacgagcgguucaacacggaguuugauggcgcccaaagaaggauccgaaaugucaagauuauaacccuaaaauccaaccucgugucuaauuuccgcaaggaauuugagcuguauaaaguucgggaaaucaacgacuaccaucacgcacaugaugcuuauuugaaugccguggucgguaacgcgcuguuacucaaguacccccagcuggagccggaguucguguauggggaauacccuaaauacaauucguauagaagcaggaaguccgccacugagaaguuucuuuucuacucaaacauucugcgguuuuucaaaaaggaagacauccagacaaaugaggauggcgaaauugcuuggaacaaagagaagcacaucaaaauauugcgcaagguacucaguuauccccaggugaacaucguuaaaaagaccgaggaacaaacaggaggcuuuucuaaggagagcauucugccaaaaggggaauccgacaagcuaaucccucggaaaacuaaaaauucauacuggaaccccaaaaaguauggagguuucgauagcccagucguggcauacucuauucugguguuugccgacgucgagaagggcaaauccaagaaacuuagaaagguucaggauaugguggggaucaccauaauggagaaaaagagguucgaaaagaaucccguggacuuccucgagcagcgaggauaucggaacguacgccuggagaaaauuaucaaguugccuaaauacagucuguuugaauuagaaaauaagagaaggcggcuccuggcuagcgcccgagagcuucagaaaggcaacgaacuggucaucccacaaagauucacgaccuugcucuaccacucuuaucagauugagaagaauuacgagccggaacaucgcgaguauguggaaaagcacaaagacgaguuuaaggaacugcuagaguacauauccguuuucucaaggaaauaugugcuggcagauaacaaucuuacaaagaucgagaugcucuuuaguaaaaacaaggacgcggaagucagcucgcuggccaaauccuucauuucuuuguuaacuuuuaccgcuuucggugcccccgcagcuuuuaauuucuuuggggagaacaucgaucguaagcgguacacaagcgugacugaaugucugaaugccacccucauucaucagucaaucacgggccuguaugagacaagaauagaccuuaguaagcugggagaggauuga

SEQ ID NO: 3006 - RNA, 4041 nt, Artificial Sequence
  Cas9 variant
augaaccagaccaagaauuacgacaucggccuggauauuggggugggaagcgucgguuggacaauaacugacucccaaucucagaaaguucucaaggugaaaggcaagcaggggaucggaguacaccuuuucaacgagggccagacggccgaagagagaaggcaauuucggaccaaucgccgacgucugaaaagaaggaaguggcgguugcgcuuacugagagaacuauucgaugagcccauuucaaguaucgacccugaauuuuucgcuaggcucaaguauuuuaacgagagcuccaaagauccaaagaauaaagguuaccagccgcagcugcaugacgaucuuaaggacguggauuucuaucggcaguaccccacaauuuaucaucugcgccacgcauugaugacucaaaaagagaaguuugacauccgagauauauaccucgccauccaccauauugucaaguauagagggcacuuccugaugaacggacacucuucgucauuuagcguggcgcagaccgacuggaaagcugaucugacaaaacucuucgaauuaauccaggagaccaggacuaaucuggacuuuaguuucgaccuuacagaaauugauaccaucaaauccuugcuguuugacaagaaccuaucucggaaugaucgucagaaagagauaguuggccucauuaacaauaacagccaacuggacaagaaagauaaggcccuuacgaagcagcugguggaguccgucgugaaaggcaucguagggaugaagacucgcaccgacauuuugcucggauacgaaguugauaauaaagagcagucaaaggcauggaacuucaguaucgacgaacuggaugaccaaauggccacaaucgauccugcuuuaagccaaaauucucaggcacaugacauuauaacucugauccagaaacucuacaugaccgugcagcuugcccagauugucccagagggucaguccgugucagaaaugaugaucaacagauauaaccuguacgcugagcaguugcaacagcuaaaggacuauaagaaaauaaaucuggagacaggccuccugcuuagggaagccuacgaugagcugaugaccaaggcguugacggcagcccccgggaaaacuauucacgacacauucuauaacaaggugaaaaagauccucaaggaucaggacaauaaacaggcucugagcaucaagcaagccauugaagauaguaacuacuuaaucccucugcggauuaaaucuaauggagucauaccauaucagcuacaucagcgagagcucgacgcaaucauugaaaaccagaaggaguuuuaccccuuccuggcuaccccuaauccaguugauggccaccaagaggcccuuccguacaaauuggacgaacugaucgguuuuaaggugcccuauuacguagggccuaugguggauccagaggucgacuccgaucagaacuucgcguggauggugcgcaaggaaaaaggagagaucacucccuggaauuuucacaacaagguugacauuacacagagcgccgauaauuucauaaaaagaaugaagaccacggacaccuaucucaucggcaaagacgugcugccucaaaacucgcuucuguaccagagguauacagucuugaaugaacucaacggcauuaagguggcaaauaaaaagcugacuaucgagcagaagcagcgguuauacgaucaacuguuuaaaaagaaaaagaccguaaagaagcaggacauucuaaacaaccucguugcugccggggagauccaugaagaugacaaucugacaggacuuucuaacgguacuaccuucaauaacaauuugggcuccuauauagauuacugcaagaucauugggcaggacaaacuggaggaugcuucaaagcaggccgacaucgaacgcauuaucgaguggaguacaaccuuugaggaugcaaacauauuccucacuaaacuggccgaaauuaauugguuaacggaggaccaaagacagaagcugagccagaucagguaccguggauggggccaguuuuccaaaacacuuuugaccgauauuaaggacaacaaggauaauucuaucauagacaaccucaugagcacuaaaaagguguucaugcaaaucauuaaugacaccacaaucaaacagaagauugaugacuauaaccaguaccaccugaaucaugcugaucuaaaagacaccaucgcgaaccuguuuacuucaccacaaaauaagcgggcaauaaaccagacacuccuggucauugaagauaucaucaacgccgugggucacaagcccaaucgaauuuucaucgagagugcuaaagacaacagaaaugccaagaaccagcuuacgcaguccagguugaaacgcauugucaagcaauucgaagauaauaaacagcauguggaccagagcguuuaugaggagcugaagcaguuagaugacgggucucacgcaucaauagaugaccggcuccugcuuuacuuucugcaaaacggcaaagacauguauaccggacagccgaucgauauuagucaguugagcacuucccaguaccacaucgaccauauucucccucaagccaaggugauggauaaugcucuggacaacagaguacuugucucuucgaaggccaauacagaaaagagcgauagguuccuguccgagaucccccaguuucagcagcgcucacucugggcagaacuggagcgaaugggcuuccuuaccaaggcgaaaaaggaacgguugcugaugacaagugacgaguuuaaacaaaacucugugcguuucauagcuagacaguuaguugagacuaggcagaucauuaagcucgugaaucaacugaucauucaggaacacccagaggucaagcuagugaacaucaaagccgaucugaccaaugcauuucgcaagaaauucaacuuuguaaagaaucggaacgccaacgacuaucaucacgcuuucgaugccuaccuaacgagccucauagggucccaccuguugaaaucacauccuaagugggaaccccuguuuguguacagcgacuaugauaagauuaaauucgacaaugcaccacagggaguuaacaucaugaaggaguuugaacagucuaaauuagcugaugagaauggugagaucauuuggaacaaggacgaaaugauggccuaccucgagagacuguauaauuccaggcaaauacuuaucaccaaaaaggucuacgcgcgacacggcaaccuguucaagcagacaauuuucaaagccggggaaagugacaauuugauccccgugaagaacaaucgcagcgauauugcuaucuauggaggcuacaaaucuaaacagguguccuauuacgcacucauaucacugcauaacaaaaagcggcagaagaggcuagucgccguuuaccugaucgacauucaaaaacuucagaaucucaacgagagugauuauuuuaagacucugcacaccaucauuaaagagagacauaauaucaagccugaguucgacauauuggcugauaaaauuuaccagaaccagcugaucaucgacaauaagaacgguagcaaucguccauuucgcauugaaggggauuucaaaaacgaccggcaauuauaucucccgcugcaguaccagagauggcuugccucgaaggaacccacagaugagaagcugaacaggaucuuugaccacauaugugaacaauuggcagauuauuucccucucuuugcgggcaaugccugcgacaaacugcuagauaaccgagacaaguucuaccagcuguccauuaaaucugaguuuaaugacaagggaaaacuuaucgcugagggcaagcucagcgugauugauaagcuguugguggccaugcacgcagacucacggaacaguaauuuagcuguaaucgggcuguccucuagcuggggacgcuucaaacuccaugguggcaacgaagccauagggacuuccguccagcugauucaccagucaccaaccggacuuuuuaagagaauccaaagguucaauuga

SEQ ID NO: 3007 - RNA, 4041 nt, Artificial Sequence
  Cas9 variant
augcugagcgccggcgugaugcucggggacgucuccgcucuuaagucuucaagaaacagucuguuccagaaaagcaagaaauugaucgaaaauuccucuucggauuuaaccaagguugacuacucaaaaaugagggaaauucugcuaagcauacggaacaucgcaauucgcuuuuucaauaacgaggauuuuaaggaaagugacuauuacaaggaguuccccacaaucuggcaccuccgaaagaaucugauggaauccgauaagaaagccgacauucgucuuguguaucuggcguugcauaacaucguaaaguacagaggaaauuuucuccaagagaacaauaaagaucugagggcugccaacgcaaaugccggugcugcagccauagaccugucuaacgcucucgaggaauauuucagcuuacacgaggaugaauccgcccugacuugcgugccuaaugucgcggaccuucagaugacguuggagcagccaggccugcggaacggggagcgccuagauagaaucguggcagcccucaauaugccggacagggcucgggccaagcuguuugcaaaggcuuguauuggacagaaaguugaguucucaaaacuugcccugggcauggagaaacaagaagguaccaacgcguacaucugggaugacgacaaguaugaugaguugguggcccucugccccgaagacuuuuucccuguccuggagacacugaaaaacgcauacagugcuuacgugcugagcgaucuccuugccgggaagcugucuauuuccgcuucauugaucgacagcuaugagcagcaucagaaugaucuaaaaauaguaaaggaacugguucgcgaguaccucggacagaaggaauauggccgacuguuuagaggcccaaaauucgccaacggggacuacaauuuuaacaagguggcaaaacccaguuauacuucuuacauucuuggagagucccuguguaauaagcaagguaccacaagggaagaguuggucaaagagcucaagcggguguucgaugacugcagcgccauccaggcugauaagcguuaucagaaaauuaagcagcgccuggaagacgauccuaaauucuuaaucaagcagaaaaccagagcgaacggcgcaaucccauaccagcugcaccuagaggaaaugcaucagauuauagagaagcaagggaaguacuaucccuuucucguggaacagcaggaccugaucgagaaacuugucucgucuaggauuccuuacuauguuggaccauugaauggcggucacgacccgaaccaccccuacccuacuaauccaaucgaucccaagcggaaauucgccugguccgugcgaaagccugggauggagcaugaaaaagcauauccauggaacguagacgaggugauagauucagaagagacagccgagcgcuuuauuagaaggaugaccggaacguguacuuaccuguauggcgaacccgucgugccgcggugcagucuccuguacgaggaguucuguguucuuaaugaacugaacggcgcacgcuggggcgaaggaaauggugacacccacagauuugauagcuccgacaggacagagaucuuggagcaacucuucaagaagcguaaacgggugacucauaaggccaucgcuaccuggcuggaaauuaaccacggcgucacaaaugugaaaaucucugggacccaagccgagaacgcauuugaaagcaaguuaucaaguuacaacgauuucugcaaucugcuaggaguagacggccucgaggauguuuguccucugacgaaagacgauauugaacagauaauccuuugggugacugucuuugaggacaagaaauugcugcuccagaagcugcagcgagcguucggugauaaguuauccgagaaacaaauugcuagcaucaugagaaagcccuaugccggguggggcaggcugucuucaaaacuuuugacaggaaucaagcgcgaaaccccauuuggccggauuaguauacucgacgugaugagagacggggauccuaggcccggacaccaucuggacgcaaugaacuucauggagauccuacgcgaaaaagauuuugguuuccaggaccgaauugaugagaucaauaaggaacggacuaaggagagcggccugcuccuguccgucgaggaccuuccagggucucccgccuugcguagaucggugaaccaggcuaugcacauucugaaagaaaucguuagcauagccggaaaggagccuuccaggaucgugauugaaguaacacgcgauccagacgaggagaaacggggccauagaaccgauacgagguacaagcaguuaucagaagcacucgcugccaucaaaaccgacauuguccaauucgauaguucucugcuugcggagcugaaggaacgaaaggacagcuuggauuccgagcgccucaugcuguauuuucagcagugcgguaaaucacuauacagcgggaagccgcuggacaucaaucggcucucugaauaucagguggaccacauaauuccccaauguuacaucaaagaugacucccuggauaacaaggcccuuguuuucgcuagugagaaucagauuaaauuggacagccuguuacucgauaagucuaucauaagaucccagaaggggagguggcaagagcugcaucgugcaggacuuaucucaaacaaaaaguuucgcaaucugacaugcacugaaauuagugaccggaugaugaaaggcuucaucaacagacagcuaguggagaccagccagauugucaaguuugugaggcagaugugcgaacaacgauaugagucguccgaaguaaucucucuccgggccagccugucacacaauuugcgcgauagauguggguucauaaaaugcagggagcugaacgacuaccaccaugcucacgaugccuacuuagcaugucagauugcgcgguuuaucggaauccgauauccuagauggcaggacgguauuagucgcgaguucaucaauaaguacauuaaacagcucgugaagaagggcaaauccucugggaaguuuuucgccggaaaaagcggcuuuauaaucgauuccuucaugcaugacgguuuugacagggaaacaggggagauuuuccgugauggcugggacgcuacuuucgaaaucacccggaugagaaggguucugggauauaaggauugcuuuauuacacgcaugccagaggaacaaaccggcgccuacugggaggagacuaucuauucaccccuugacgcuaaaaacgggaagaaucugcagauaccuuugaagcagagcggaaaagaaggcuaccucgauccaaagaaauauggugggacgaacacagcuuucaacgccuacuuuuucgcauuugucgccaaggacgcucgaggaagagauaaauacuucuuugagggcgugcccguguaucuggcgaagcagcuaaaugaacaaccgcagauccuggucgacuucgccaacaguauugcagcuaccaagaaauguucuacugccaagauccuucgguccaaaguuccucucaggcagaaguuucuguuggaugguaccagcuucuaccugggcgggcgcacaggaaauaaaaacgugauuuuaucgggcguggaguuugccugcgggaucgacauggcuaagaugauagauaccgcaauuaagcacccagaggaacucucacaaaaagagcugaucucuaucauucagaugcuugccgacacuauagaacguaauagugauagacaggcgucccugaucaacuuccggagguucgacgacaaguugcgcaauauugaugcuaucgccgcaagccgaauuaucaaaaaccucuuaaauucuaugaacggaguaaagcagagcugugaccuauccgaucugggcgguucaaaacaaaguggguuuaugcagagcaauauagccacacuuuucgagagaaucacguggugcuauucuuccauuaccggaauguuugaacagcgggucucauucgaggaccucaagaacggcaucuga

SEQ ID NO: 3008 - RNA, 4041 nt, Artificial Sequence
  Cas9 variant
augaagaaaagaaacagggaggaauacuaugugggccuggacaucgggaccagcuccgucggaugggccguugcuacacccgauuaccggauuccuaaguuccgcggucacaaaauguggggcucucgacucuuugcagaggggaagcgugccgcggaaagaaggcaguuccggacuaaucgcagaaggcuugcucggcgccgagacagacugcaaauauuggaggaauuauuugccgaggagauggcaaaaguggauaacacguucuuuaugaggcugaaggaaucaaaguucuuucuagaggacaaaaccguaaaggaaaaacauauccucuucaguacagauaaguuugacgccgaucgguucuauaaagacaauccaacuauuuaccacgugcguaagcgccugauggaggaggaaccgcaggauaucagagagcuuuuucuggcuguccaucacauuuugaaguauaggggacauuuccucuuugcaggcagccuggaacagaacggugacuccaucgaggaacuggugcggacccucuucgggaaacagggauuagccauacuggaugacacaaucgauucuaaugagaugguuaacauucuuaagaauaacgagaaaaccaagucggaccgcaaaaaggcugugcaagaauuguggaauccccugaaagacaaggucaagaaagcccaggcggcagagauggccggcgugguacuaggccucaacucagauaucagcaagcuguucgacaauagugauuacaaagaccuuaagauuaacuuuuccucuggggauuaugacgaaaaacgagaugacuacgcuaauagcaucggagaugacauaguucuguuggauacuaugaaggcccucuacgacacacugauuuuaucccagauccugcaggguaagcaaucaauuagugaggcaaaaguggaagacuauaacacccacaaggagcagcucagagcucuuaaagccauccugaagccucacaaaagguuguacaaugagauguuccgggaaaacaacaagaaggaucuaagcaauuaugucgcguacaucucuuccuauucagagggcaaacgcgugaacagagaaggguuuuacaaguaugugcaggccguccugaaacagguugacgauagcgacaguaagcaagcaauucucgaggcuauaaggcuggaaacguuccuuccacuguugcgugugaaagauaaugccguaaucccccaucagauucaccaggcugagcucgaggccauccuggaaacugcacggaagaaguacaaauuuuuaaacgacgugucugagggagucuccgugaaggauaaaauaauucaacuguucaccuuucgaaucccuuacuauguuggcccacuaaauccccauagcggugaaacaguggccgacagaaagcaggggacuggaugggucgugaggaaacagcgcggcaagguauacccuuggaacuucgcugauaugguugacgugaaagcgucggcagaggccuuuaucaccaaucucacaaacaagugcaccuaucugauuggcgaggauguccuuccaaagcggucuuugcuguacuccgaguucaugcuccugaaugagcuuaacaugaucaaauaugacgggcacgaacugccgguggagauuaagagauuguacauagaacaggucuuuaaacaagagcacaagaaacagacgaagggaagggugcucgauuuccugaagcgcaaugguuuaaucacuggcucagcuacagccguuauuaccgggauggacgacaguaucaaaggagaucugcagagcuaucgagacauggugcggaucuuuggcacugguuucgaucauuccauggcagagcguauuauaagauggguaacacuauucggggaagccaaggacauccucgagaacaaaauuagggaagucuacggcaauucuaucagcgauucacagaugcgcgcuauuaagaaacugaaguacgccgacuggggacggcuuagucaagcauuuuucaucaagauaaucggcugugauaaauccgggguggagagaaacauuauuaccugcuugagggaaagcucucagaaucugauggagauccucucagaccagggaacguauaucaagcagauaaaagcguggaaccaccaacauaccacaaacaugauggauacucuggacuaccaguuaguugaugaccuguauguggcucccagugucaagcgaagcauuuggcagucccuuuguaucguggaggaauugguaaaaauuaugggucaggccccuaagaagaucuuuguggagguuacccgcacaaaucaagcagagaaaacuaagaaagauucucggaagaaaagacucgucgaacuguacaccgccauaggcaaggaaggggcugccuggaaaaaggagaucgagaagcaccaggcaggagacuucaggcguaaaaagcuauaucuguacuauacacagaugggccgcugcauguacucgcaugaaccaauugcuauggacgcccucuuuaccagcgaguacgauaucgaccacauuuauccccaaucccugacuaaagaugacucaugggauaaccuuguguuggugaagagucagcugaauaaagaaaagucugaccaguacccuuuacggccagcgaucagagagaagaacaaagccuauuggcaguaccucuguagggcugguuucauaagcgagaagaaauaugaacgacugaugcggacgacagagcuuaccgcagaagaacuguccggguuuauugcccgccaauuggucgaaacuucacaggcuaccaaggccguuaucggccuccuggagagaaucuacaaacacacagauauuugcuucgugaaggcagagaccgugagccaguuuaggcaucagcacaauuucaucaagauucgggaacuaaacaauuaucaucacgcgaaagacgccuaccugaacauaguagucggaaauguguaccacgagaaguuuacuaaaaacccccgagaguucaucgcuagaucuacagaacgcaggccguauaaucucaaccguauguacgauuuugaccugcuuaagcaaggccggguuauuuggcaagugccuaaauccuuggaaacgguccaggccaugaugaagaguaaugaugugagaaucaccaagaaacuguuaguucagaagggggagcucuaugacgcaacuauuacaaaagcucauaagaccaaagagggaauguacuucccccugaagggugccgacgcaaggcuucgcgaugugcaccgauauggcggguacgaaaagaucaaaauagccuauuacagcguauucucuuguugcgagaaggcuuccgacacaauccauacucugauuaucccaauuccugucuacgcggccggacuacuccagaccgaagcagaucugacggcuuaugccuggcagaccaaacagaagacaaaacccaucaaggacauauacucaaugauuacuccaaucuauaaaaaguuguguaucaacaccguggugaagauugauggcuuuaaauacuuccugggugggagaacagaggacuauauaugcuuauaccccgccaucccugucguucucgaugaacaagcugcagccuaucugaaggcggugaguaaaguaggccgggcugacgauguggagaauacugcccaggcaauugaccuuaucaccgccgaggcuaacgaagcauuuuacgauguccuguugaagaaaauggaggccaagauuuucgugaaggcguaccaggaaaggguugagaaacucgcuagcgagacggcccgcgaacguuuuagaaagcugucgaucggagcacaguguuccugccuacuggagauacuuaaccuccuggccaauaacaaaacaaccucuaauuugaagaaauggcugggcgugacuaugagccggaggaagcaaccaauggacuuaacaaagcucgaagagugcaucgucuaugaaaccucaauuacugggcuguacgagaaagcugugagucuucuguga

SEQ ID NO: 3009 - RNA, 4041 nt, Artificial Sequence
  Cas9 variant
augguggagcacuacgccaucggcuucgacauugggaccggaagcacagguuuugcuggcgucgaucccaacgggaagcugguuagaaugaggggcaaaaauguguauggaguauaccgguucaaggguggggaagcagccgcggaccgccgaggauuucguacuacgagaaggcggauaaaacgcagaaaguggaggcuccgguuccuuaaauccuuuuucgagccuuauaucgcuccaauugauccggaauuuuuccugcgccagaaguacucugccgacucacccuuggauccuaagggcauccgagcagacaaaggcuuacugagugauaugagcgaccaagaguuucaugccaaguauccaaccauuuaccaccuaagauaucagcucaugcaugagaaaaggcaguucgaugugcgggaaaucuaccuggcuaugcaccauauaaucaaguaccgugggcacuuucuuauugaggacggagcagauaacuucgacgccaaacagaucgauuucuucgaccaauuccagcgcauggcugccgucacagcgggucugcccgaauuggagacucucgugguuccugacgaaacccaguccgaugcauuuaagagagugcuguucgacgagucucagacaaagucggauaggcaaaaaguccuggccucacagcucuuagacauucaggauaaucagagcaaggcuaucaaagacuuuauagccgcacugaccaaggcugugguaggcaugaaagccaaccuugcgacuuugacaaguaccgccauugaguccacggauaagaaugacuggacuaaaccacuggggcaacuagaugacuuccuccugaagcacgaagaggaucuugacgaagacggauaugcacugaucgaugcugccaaccagauguacucugcugccguuuuggcagcccucgugcccgagggcauggguuuuagcgaagcuaugauggcgcgguaugcacagcauaagaaacaacuggccuuauacaagcaggucauugcuucccugccugacaaaacccagcgacacgagcucaaggaugccuaugcagacuacaucgagcaugccgcucagaauccacgcgaugccuucuauaaaagagugacaaaggugcuugaaggggucgacucagcagaugcgaggacuguuaugaccgcuaucagucacgacgaguuucuguugaagcaacggacacuaagcaacggaaaaauuccguaccagaugcagcagcacgaauuugaugccauaaucgagaaucaaaaggcauacuaucccuggcuggccaccccuaacccaguggaagcugacgccaaacgccuccccuacuaucuggaugagcuuauuggcuuuagaguaccuuacuaugugggcccaauggucacggagaagcagucucaguucgcauggaugaucaggaaagcugacggggaacugacucccuggaauuucuucgaugugguugaccgugagaagacagccaaccgguuuauacagcgaaugcaaaccacugacaaguacauuuugggagaagaugugcucccgaaacauuccauccuguaucagcaguucgaggucuuaaaugaacugaacaauaucagaguggagaagcacccucuaacaaccgagcagaaacaauucauuuaccagaggcucuuuguagaccagcaacgcaagacgaucaccaaaaagaaccugcaggauacacuuguugcgaugggugaauuugacaaggcccccgauauuggcggguuggcuaaagaggacgugaugaugucaagccuggcaacuuuugccgauuacaguaagauacucccagaagcuaucucugacccuacccggcagaacgauauugaggacaucaucgccugguccacaauuuucgaggauacucagauauuuuucgacaaacugaagaccgucgauuggcuuacaacccaacagagaaaaaggcuggcaagcauccgcuauacuggauggggcaaguugucgaaacgacuccugcagcagauucccacgucuaagcauacaaaugugauggcggccuuaugggcuaccuccgacaacuuuaugcaaauccugcaggacgaacaguuccaggagggucuauacgaugccaaucggcucccagaagagacucugacccccgacgaacaagucgagaagauucuugaugaggcauauuugaguccugcugacaaaaagggggcccguaaagugaucaagguuaugaacgauauagugagagcaaaucacggcguacugccagaacaggucuuucucgagucagccgacgauccgcagaaaaacaagaggcgcagcgugucccggucuaagcaacuggaagagaaauacagacaggcugcgcagagcuucaucgacgaagccguuaaggaggaguuaaaugcacagauugugaacucagcugaauuuaaugauaggcugguccuuuauuucacacaaaacggacgagacauguacaccggcaaacgcuuggauaucgagaaucucgggaguuaucagauugaccauauccugccccagucccuagugaaggacgauagccuggacaaccgggcccucacugccagagauauaaaugcugaaaugucuaaccaguuuguaucagagagguucggacuggguccucgugcauucuggcaacagcuuaaaaauaacggcuugauuagugggcgcaaguuucggaaccuggugaugcagagagacgaaaucgauaaguacgccccaggauucauuaauaggcaguuaguugagacacgacaaaucauaaaaacggucgagcagaucauucaccggcucuggcccgacauccagauugugaccaucaaggcgaaccugacucaccaggugcgcagcgaacuuggcuuuccuaaagucagagagcugaaugauuaccaucacgcuuucgacgccuugcucgcagccaggauaggucaauaucugcuagaacauuacgcugggcugaagccauuuuucacauauggcgaguuuaaacggggagauaccaagaaguacggcacaacuaacuuccuccgaagacugaccaaagacaauaaggauaaaaagggggagcuuuugcccgaaguuuccgacuggauugauucuaucgacucgaucuauaacuacaaaaagauuccgguggugugggagaauacgaccaacaugagcgcacuguuugaccagacaaucuauccucgcccagauagggacacuaccaaacguaaguuaauucccacaaagcucgauaaaccuacugacauauacggagguuacuccucagccaagaccgcguauauggcuguaaugcggguccagacgaaaaagggcacagaauaccccguguucaauaucccaguuaguauugccucucaacugaacagaaucaccgaucagacuaugcuuaaacaacaggugaagcaguuuauuaucaaugcagagcagagcgccuccaagaaaaagcuguaugaaucaggggacgucauacuaagcaggguggcucucggacagcgcuucacagauaaaaacuacggcgagguuuuccugaucucuaauauggaggugcagaacccucaauccuuguggcugggucgagccagucagcagagauuaacccgggaacccgaggggaaugaaaagccagagacuagccucgcagacauuuaucagcaaauccugaaacagguagauagguacuuucuugcuuucaacauucgccagcaacgucagaagcuguugggcacccucgaccaguuuacaucucugccggucggaagagugaacgaacagacgcggaccgaucaaaaucagagguccaucauagcccgcgugaugauuguccuaggcaaggggucacgagaggagaaauucccugaauuuggacugagugcgcuuggcagacucguucggacuggugggaucacacugagcgaggacgcccagaucauuuaucagucgcccaccggauuguucgaaaggcgcguggcacugaaggauuuauga

SEQ ID NO: 3010 - RNA, 4041 nt, Artificial Sequence
  Cas9 variant
auggccaagauccugggccucgaccuugggaccaacagcauuggaugggcuguggucgauauagagaauaacaaugaguucacacugaucgagaaagguguuagaauuuuucaggaaggcgugaagaucgagaaagggauugaaggauccaaggcagccgagaggacuacguaccggucugcgcgccgaaucaaauaucguagaaaguugaggaagauacaauuacugggcguacuaucagagaacgguuacugccccuuccucaguaaagacgaacuggauagcuggcgguauaagaaaguguacccuaccaauaaguccuuucuuaacuggcagaaaacaaaugagauccagcuggaaaacccauauuucuaccgcgcuuugcucgucgagaagaagcugaaucugaacauugaggaagacagauuuaaaaucgggagggccuucuaucaccucgcacagcggcgcggauuuuuaucuaaucgaauggagggcacuaaggaaaacgauggcaccgugauuaaaucgaucacagagauaucaaccgccaagggggacaaaacucugggacaauacuucuacgaaagauauaagaaaggugagaagauuagggauacauacacccaucgggaggaacacuaucuugaggaauuuguucguaucugugaguuccagcaguuggacaauaaguuugcugaaaaagugcgcaaggcaauuuucuaccagagaccgcugaaaagccaaaagggccuaaucgggaaaugcgucuuugagcccaagaagaguagguguuccgugucucggccugaguucgaagaguaucgaaugcucugcuuccugaacaauaucaaaauuaagacgccaagcgaugaaaaccuucgcuuucugacugacaacgagaaagaaaaguugaaaccccaguucuuuagaaaguccaaggaucauuucgacuuugaggaucucguaaaacagcuggccccuaagaaucaguucaaauuuuacaagucaagggacauauuaccaggaaacuggcuguucaauuauaguaugaacaccacaguuagcggcugucccaucucugcucggcucaaagaccuuuuuggugagaauuucauggauauuaaguuugacuacauccgcgaaaaggaugggaaaaaguccgugauagacauucacgauaucuggcauguccuguucacuuacgacucagaggaaaaauugaaggaguuugccagaaacaggcuaaaucuggaugacaucaaaauuaaggaguuccaacguauccagcucaaaaaggaauaugcggcacugagccuuaaggccauucggaaaauacugccuuucuugcgagagggacucaucuacagucacgcuguguuuauugccaacauggaaaccgcaaucccaucugagaucuggaauaacuauacaaauagaaacauuauaaagaaugaaaucuacaacauuaucuccaaucagaccgaggauaaacaaguggucgacauuguuaacggcaucauaaagagcucgaggaucgagaacucugugugguccaaugaagcuguagaguucuuuaaaaaggaucugaacucaaagauuaaaaauuauuacggcaucaagacguauaacgacuucccggaagagaaaaagauucgcaucgaaacuuacgccuuuaauuuauucaaacagcagaugaugaagaacuuugggcggggagaguucgcggccgugcagagaauagacgagaggcugaagcuauuucucacagauaauuucaacauugaccccauccugcuuaaaaagauuuaccacccuagugcaaucgaagucuaucaaccacccgugcgcaaaaaugaugguaaguuguaccugggcagcccuaugguuuccucuauacgaaacccaauggcuaugcgggcccuccaucagcugcguaaacuuaucaaugagcugauuagaaaggaauugaucgacagcaacaccaaggugaauauugagauggcuagggaacucaugaacgccaaugagcgcaaagcauaucagaacuggcagaacgaucgggagaagaucagaaaagaauacgcccugaagauaaaacaacacuuagacgucgauaaggagcccucagacguggauauucugaaauaucagcuaugggaagaacagaaucauaagugcaucuacacugggaaggagaucaacauuagugacuuucucggauccaauccgaaauucgauaucgaacacacaauuccuaggagcauaucuuuugacaacucacagaguaauaagacccugugugagaacuauuucaaucgaagcguaaagaagaaccgcauccccgcugcgcuuccaaaucacggcgaaauuaucgagcgguuggaaaacuggaaacugaaguacgaggagcucgaaaagcaaauucaguacgcaguuagacaggccaaaggugcuggggauaaggacuccaaagacagggccauccagaagcgucauaaacugaaguucgaguaugauuacuggaagaauaaauaugaccgcuuugugauggaagaugucccugagggcuucaagaacucucaauuaguggacacgggaauaaucaccaaauacucgcggauguaucugaauacacuuuuugauaaggucuacacugugaaaggcaacaccguugcagacuucagaaaguugugggggauucaggaugaauaugagaagaaagccagggugaaucacagccaucacugcguagacgcuaucacaauugccuguaucacuaaguccaacuacgagaaccucgcaaaauuuuaccaugauugggaggagcugcacgucaagggaauagaccagcuacccccaaugaauaaacccuggaagaccuucacagaagauauuaaggcgauccaauaugagauccuggugucacacuacaccccugacaaccucccaaaacagaguaagaaaauucugcgaaagaaaggucggauacagaagaaugaaaacggcaauccgaucuaucuuaaaggggauacuguucgcggaucuuugcaucagcaaacguuuuacggcgcuauugagaagacagaggugaacaagaaaggugaacccgagaaggucaucaaauaugugguaagaaagagccuggacguguuagacgauuccucaguuaaaaauauugucgacgauaucgugaaggaaauagugcagaacgccaggaucaaggagaaagacuucauuaaggagcucgaaauccagaaacggaagcuggcaaaagccgaggaaaauaaggucguucagauucaagcugagaucgauaaacuuaacaaacagguggccgaccuguacaccaugccuaauaagaacgggaauccaauacccauuaaaaaggugcgaaucuuucagacuagcguaaccaacccuauccacuugaaacagcaaagagauaagucucagaagacauccaaaccacauaaggaguucuauuacgcagcuaaugacaguaacuacaugauggccauuuaugaaggcaaagaugagaagggaaaagucaagcgcgacuuuaaacuccugaauaaccuagaagcgggcgaguucuucaaguacagcgugcacaaggaucugaaagaaaagaaccucgagaauaucaggaacguuauacccgacaaagugucugccgggaagauugaaaucccgcugaaagcuauuaucaagaccggaacuauggucauacuuugggaaaauuccccugacgaggugugggauuugacaauuucagaaguugacaagcgucuguauaaagugguagguaugagugucaaccggaucaagagcgaugugaaaacguuugaguucggcaauaucguguuaagacacaacaaggaagcaucgccagccacccuccugaaaauucaggacggggaguuuaaguccgaugaaaauuacaucgcucaaaggaaacuuucucauaaccaguucaaugcccuggucgagggaguugacuuuagccuaucagugcucggcgagauuaagcgccugaaguga

SEQ ID NO: 3011 - RNA, 4044 nt, Artificial Sequence
  Cas9 variant
augggcgaggacgggaagcccgugagagucaaaggaaagaccgccaucggugcuaggcuguuccaggaaggccacguugcagccgaucggcgcauguuucgaacaacucguagaaggcucaaccggcgcaaauggagacuuaagcuguuggacgagauuuucgauccuuacauaacgccaguggacagcaccuuuuucgcgagguuaaaacaauccaaucugucuccgaaggauucacggaaggaauuuaaagggaguaugcuauuccccgaccucacagauaagcaguaucaugaggacuacccuacuaucuaucaucugcgccgagcucuuaugaccgaagauaaaaaguuugacauuagaaugguauaccuggccauccaccacauugugaaauauaggggaaacuucuugaauagcgcaacagucgauaccuuuaaggccuccaagguggacuucaaaaagucuuuuaaccagcucaaugagcuguacucggcuaucaacccagaggaugcauuccagguugacaugaauaaaucagacgaaacuggccggcuguuucucgauagcaguauacguaaguucgacaaacaaaagcagaucuccaaauuaauucccguggucguggaggauaaggaagccaagaaacugaacgguaagaucgcucuugagauuacaaaagccaucuugggguauaagucuaaacugaauguaguuacccagacggagccugaagacccaaagaagugggcggugaaauucgaugacgaggauauagacagcaagcuaaacgauauucuccccgaaauggacgagaaucagcaauccaucgucgaaauuauccaggaucuguacucacaggugacucuuaaccagaucgugccuaauggaaugagucugagcgacucuaugauuaaaaaguacaacgaccaucacgagcacuugaaacucuauaagaagcugauagauaauaucuccgacaccaaaaagcgcucagcauuaaaaacagccuacgauaaguaugucggcgacgauggcaaaacuauugagcaagacgaauuuuacagcaacguuaagaagaaccuggaugacagugaucucucuaaacagaucgcugaccuuauagaggccgaaaaguucaugccaaaacagagaaccucccaaaauggggugauuccgcaucagcugcaccagagggaguuggaugaaaucaucgagcaucagagcaaguauuaccccugguuugcagaggcuaacccuaauaaacacgaccuacaccuggccaaguauaaaauugaagaacucguagcguuccggaucccauacuacgugggacccaugauuacaccugaagaucaagagaagucgucucagaccauauuugccuggaugaagcgaaaagaaccaggucagaucacgcccuggaacuucgacgagaaggucgaccgcauggaguccgcaaauagauuuauuaaaaggaugacuacaaaggauaccuaucugaucggcgaagacgugcuuccggaucagucacuguuguacgagaaauucaagguucucaacgaacugaauauggugcgggucaacgaccauccuuuaaaggugagugagaaacaagcuaucuaucgcgaucuguuugagaaucagaagagaauuagcguaaagaaccuacagaauuacguuaaguccaaaucugggcuccccacuggaccaaagauaagcggccugucagacccugaucacuucaacaguucccuugguacauauaaugacuuuaagaaaauguucggggauaagguggacgaucccgacuugcaggaugacuuugaaaagaugaucgaguggagcaccauuuucgaagacaagaaaauccugagggccaagcucgaugaggucgcuuggcugucugacacgcaaaagaacgaguucaaagagauucguuaccagggauggggccggcuuucaaagaaacuguugaccggcaucguggaugggaauggacagcgaauaaucgacgagcucuggaacacaaacaagaauuuuaugcagauucaaagugaugacagcuucgccaaaagaauccaugaagcaaacgccaaucagaugaaggcuacugaugucgaggacgugcuggcggaugcauauaccuccccacagaacaaaaaggccauuaggcaaguugugaagguagucgacgauauccagaaagcuauggguggcguggcccccaaguuuauaucuauugaguucacacgcucggaagaccggaauccuagaaggacuaucagccgccagcgacaguuagaaaacacccugaaagacacagcacaagcccuaguuaaguccauuaauccagauauccucucagagcuggacaacgcuaguaaaucuaagaaggggcuuaccgaucgguuguaccuguacuuuacucagcucggaaaagacauguauacgggcaagccgauaaauaucgaugagauuagcaacuacgacaucgaucacauuuucccccaggccuuuaucaaagacgauucccugaauaaccguguguuagucucaaaggcagguaauaacgggaaaagcgcgaaugugccucugaaacuuuucggcgcuaagaugggaggcuauuggaaacaguuggccgacgcagggcucauaggacaaagaaagcugaaaaaccuacagacaaacccagauaccauuucuaaguuugccaugcaugguuucaucaggcgccagcugguagaaacuucccaggugaucaaacucguugcuaauauucugggcgacaaguaccggaacgaugacaccaagaucauugagauaacagccagaaugaaucaccaaaugagggacgaauuuggguucaucaaaaaccgagagauuaaugauuaucaccaugcauuugacgcuuaccuuaccgccuucuugggacacuaucuguaccaucgcuacaucaaguuacggcccuauuucgucuacggcgauuuuaaaaaguucagagaagacaaagugacuaugaggaacuuuaauuuccuccacgaucugacagacgauaagcaggagcguauugcggacacggagaccggugaagugaucugggaucgcaagcggaguauacagcaacuuagagacgucuaucacuacaaauuuaugcugaucagccaggagguuuucucuuugaacaaggaaauguuuaaacagaaacucuucccugccacucuggcuaaaaaguccaaacuaauucagaucaagaaggauaaaccaguggacauuuaugggggcuacucaaauaacacagaugcauaucugaccgugguaaagcucaaaggaaguaaggaggacaaauacaagaucgucggcgugcccaugagggcccuggacaaucuuaagcaugcugagaaagaaagcccgcaaucguacacagccgaguugcgaaaggcacuggaaccucaguuuacuaaaauaaagaaaaaccggaagaccggggagguuuccaagguggucacgaauuucgauauuguguuaggacgccucuuuuauagacagaugguuaucgacgguucugagaaaagccugaucgcgucaaguguguaccaguauaacgccaagcaacuuguacuguccgaucaggcuauuaggaccauaucugaccaggaaggcaucgaugaguucgaacuaagcucccaguacgacaaagucuaugaugagauugugcaaaagguggaaaaacuccugccaaucuuccagcaccggcauuuucaggagcgauugaauaacgggaagucacuguucgucaacuuacccguucacgacguguacgaaggaaauaagcucgagcagguaggcaaaaagcauauuaucaacagcauacugggugggauccacgccaaugcagauagaccugacauugaucuuuuuggcaucaaaaaccugggacaauucaguucuacauccggcauuaauuugagcucggacgcuaucauaugcuaucagucacccacugggcucuuugagcgcagggugguccugaaggaccuauga

SEQ ID NO: 3012 - RNA, 4044 nt, Artificial Sequence
  Cas9 variant
augaccaagagagaggaacccuacaacgugggccuggacaucgggagcuccucugucggaugggccguuguggauaauaacuaucaccuccuuaauauuaaaaagaacaaucuguggggugcuagguuguucaaagaggcagaaacagcccagguaacucggggccaucgcucaaugcgacguagauacaggcggcgcagaaacagguuaaauuggcuggacgagcuauuugcggaugaacucgcuaagauagacccuaguuuccugcuucggaugaaaaacagcuggguguccaagaaggagucuacgcgcaaacgagauccauauaaucuguuuaucgacgagaaguacaacgaugucgacuauuucaaucaauacccgaccauuuuucacuugagaaaagaacucaucacagaggauaagaaaguggacauuaggcugaucuaucuggccauacauaacaucauuaaguaccgggggaauuucacucucgaaaaccagaauuuugauaucucgcaguuaucaagcaacuucagucagcaaauuuccgacuuuuucgcacuguuuucugauuucggaguuaucaugcccgaggacuuugacccugauaagauaagcgacauucuuuugaacccaaaucugucccccucaggcaaagugagugaggccaucgcuaccauuagcccuaagacaaacgucaaagcaaagaucaaaaucauucuacuccugcuuguggguaauaacggggaucugaagaaauuguucgaccucgaaaccacugagaagauagccguaaagcugucuucccgucacaucgauucagaauuaccaauuauccugagcgagcucaaugaacagcaggagaacauaauuacaaucgcuaauaguaucuucggaucuauuauccuuaaagacuuucugggcgaugagaccuccauuagcgccgcgaagguuauaucguucgaagaccauaaacaggauuugcaaaagcuaaaaacgauguggcgcgagacuucuaacaaggaagcagugaaggccggcaaaaaggcuuacgaggacuauaucgggcacgaagauuccgagaccuuuuacaaaaagauuaaaaaguuccuggagaaggcccagcccgucgaccucgcaaauaaagcucuggccgaaaucgagcuugaaaacuaucugccuaagcagagaaauaggaacaauacagugaucccauaccaguugaacgagaaugaacucauugcgauacuggaccaccaagagaaauauuacccguuuuuaaaggagaaccgggauaaaauccugucacuacucacuuuccgcauucccuauuacgugggaccucugcaggacaguaacaauaaccgauuuagcuggaugaccagaaaggccuccggugcaaucaggccauggaauuucucugaaaaggucaacguugagcagagcucaaaugauuuuauuaaacggaugcgcaguacagacaccuaccuuaucggcgaacccguguugccuaagaaaucccugauauaucaaugcuacgagguacucagcgagcugaacaauacgagagugaaggaugggucuucaaacccaaaaaggcuugacgucacuaucaagcagcguauuuauaaugaaaucuucaaaaaccagaagagugugagcguuaaggugcugcagaauugguugauuaaagaguccuacuuuaagucucccgaaaucucgggacucgcugauaaaaagaaauaucugagcuccuuaucaacauacauagacuucaagaagauuuuuggccaacgguucgucgaugacccggugaacaguccucagcuggaggaacuagccgaguggcucacccuguucgaggauaaaaagauccuuuugauuaaacugcaaaauucuaaguauagcuacgaccaggcuacuaucaacaaacucuccacaaugcgauaccaggguaccgggaagcugucaaagaaauuacugguagaucuuaagacgaccaaaaagagcauaggaaaaucuggcgccgaauccuugaguauccucgaccugauguggagcacaaaggacaauuuuaugcagauuauccaugaugcagacuauacuuucgagcagcagauuaaggaauuuaacuacgauaccgaggacgaacuaacaccccuggagaaaguugccaaccuccacggcucuccagcucugaagagagggcuuaaucaauccaucaaaguggucgcggauauagugaaguucaugggacaugacccugagaaaauuuuuaucgaguucacuaggucagaugacuuuaguaaguugaccaucagccgcuaucggagaauuaaaaagcaguaccuggaaaucgcaaaggccauuaaaaagauacccgcugaguucaaagauaucaaggaauaucagacacaguuagaagagaacaaagguaagcucgccucggagaggcugaugcuuuacuuucugcaauguggccacuccuuguauucuaauaagccaauugaccucaacaugaucaauagcucaaaauaccacgucgaucauauucugccccagaguuacaucaaggacgauucccuagaaaacaaagcacuggugcucgccucugagaaugaaaacaagauagacaauaugcugaucagccacgacauuaucgcuaccaaccuuccucgcuggcaggccuugaaagaucaaaaucugaugggguccaagaaguucgcagacuuaacucgaacgacaguuaccgagaaccagaaaaagggauuuauucagcggcagcucgugcaaacuucacagaucguaaagaauauaacccugauucuuaacgaucuguauaagaauacaagcugcaucgagacccgugcgacucuaaguucugaguucagaaaggcuuuuuccaacuucgacgaaacaacguaccauuaucaguucccagaauuugucaagaacagggaugugaaugacuuccaccaugcccaggaugcauuucucgccuguguuaucggcgaguaccaacugaagaaauauccgaaggacaacuugcgccugguguacgaucaguauagcaaauucuuagacucgcucaagaaagauacccggaagaagaaugguagaaugcccagguacacucagaacggguuuauuauaggcucaauguucaauggaaaaacauacgucgacgacaacggcgaaaucauuugggaucagaagaucaaagagucuauucgaaagaccuuuaauuaucaccaauucaacgugguacgccagacaaucgagcagcacgggaaacuguuuaaugacacuauacaaccucauagugaucgguacaaacuuaucccacugaaaaccaacagagaccccgcuauuuauggagguuacaauaacgauaauaacgccuauuccgugguuuuggacgucgauggcaagaagaaaaucaaugggauuccuaucaggauagcaaaccagcucaagagcgacgaacuggaucuaucuagcuggcuggagaauaacauuaaacacaagaaaccaaugacgauccuuaucgacaaggugcccaaguaccagcguauuaucaacgaagagaccggagaucuccugauaacauccgcuaaugaagugauuaacaauguccaguuguuccugccgucaauguauacugccuuaaucagucuccuggacagcaccaaaacagagauguacucuaaacuucuguccaacuacgaggcgaauauuuugaucgauauauaugacuaccuccugacuaaacuaaagaacaauuauccucuguaccgcaaagaaugggccaaacuugcugagcaucgggacgauuuuauugaaucagaccucguuacccaagcaaguacgcugcagcaguugaucaaguucaugcacgccgauccaagcaacgugaauuuaaaguucggcaacuuuaaggguaauagauucgggaggaaaaacggcaauaucaagcuguccaaaacagacuuuauuuaugagucucccaccggacucuucaagucgaucaagcacauugauuga

SEQ ID NO: 3013 - RNA, 4044 nt, Artificial Sequence
  Cas9 variant
augaaaagcgagaaaaaguacuauaucggccuggacguggggaccaacuccgucggaugggccguuacagaugaguucuacaauauucucagagcuaaagguaaggaccuuuggggcgugaggcuguuugagaaagcaaagacugccgcggauacgcggaccuuccgcucugggcgacguagaaacgacaggaagggaaugcgguugcagauauuacgcgaaaucuuugaggaugaaauuaaaaagguagacaaagauuucuaugacagacuggaugagucaaaguuuugggcugaggacaaaaaggugaguggcaaguacagccuauucaaugauaaaaacuuuuccgacaagcaauauuucgaaaaauuucccacaaucuuccaccucaggaaguaccugauggaggaacaugguaaagucgauauucgguauuacuuucuugccaucaaucagaugaugaagcgccgagggcacuuccugauagacggacagaucucucaugugacugacgauaaaccuuugaaggagcagcucauucugcugaucaacgaccucuuaaagauugagcuggaagaggaacuuauggauucgaucuuugagauauuggcagacguuaaugaaaagagaaccgauaagaaaaacaaucugaaggagcuaauuaaaggccaagacuucaacaagcaggagggcaauauccucaacucaauuuucgaaagcaucgugacagggaaggccaaaaucaagaauauuauaagugaugaggacauccuggaaaagauuaaggaggauaacaaagaagacuuuguccuuaccggagauuccuacgaggagaaucugcaguauuucgaagagguguugcaggaaaacaucacucucuuuaacacacugaagucuaccuacgacuucguaauauuacaaagcauucugaaggguaaauccacgcucucagacgcucagguugagagguaugaugaacacaagaaagaccuugagauccugaagaaagugaucaagaaguacgaugaggacggcaaauuguuuaagcaggucuucaaagaagauaaugggaacggauaugugaguuacauuggcuauuaccuaaauaagaacaaaaagaucacugccaaaaagaagauuagcaauauagaguuuaccaaauacgugaaggguauccuggaaaaacagugcgacugugaggaugaggcagucaaguaucuccuggggaaaauugaacaagagaacuuccuucugaagcagaucucuuccaucaauucaguuauuccacaucagauacacuuguuugaacucgacaagauccuggagaacuuagcuaaaaauuacccgagcuucaacaauaagaaagaagaguuuacaaagauugagaaaauccggaagacuuucaccuuucguauucccuauuacgugggaccucugaacgauuaucacaagaauaacggcggcaaugccuggaucuuccgcaacaaaggggaaaagauaagaccauggaacuucgagaaaaucguagaccuacauaagagugaagaggaauuuauuaaaaggaugcucaaucaaugcacauaccugcccgaggagaccgugcuuccuaagucuuccaucuuguauagcgaauacaugguccugaacgagcucaauaaccugcggauuaagggaaaaccacuugauacggacgugaagcugaaauugaucgaagaacucuucaagaaaaagacuaaaguuacacugaagucgauacgagauuacaugauucgcaauaacuuugcggacaaggaagacuucgauaauucugagaaaaacuuagagaucguguccaauaugaagucauauauugacuuuaacaauauccugggugauaaauucgaacuagagauggucgaagaccucauagagaagaucaccauucacacuggcaacaaaacacugcuuaagaaguacaucgaggaaaccuaucccgauuugaguagcucccagauucagaaaaucauaaaucugaaguacaaagacugggggagacucucuaggaagcuguuagauggaauuaaaggccggaacaagacggacgaugugaauaccguaaucaacuuuaugcgcaacagcucagacaaucugaugcagaucauugaggguaagaacuauaguuucaaugaauacaucgauaaccuuaggaaaaaguauauuccucaagagauauccuacgaaguuguggagaauuuguacgucagcccaucugugaaaaagaugaucuggcaggucauuagagugacagaggaaaucacuaaaguuaugggguaugacccggauaagauuuuuaucgagauggcaaagucagaagaggagaaaaagaccacaauaagucguaaaaacaagcuccuggaccuauacaaagccaucaagaaggacgaacgggauagccaguaugagaaacugcucacuggccugaauaaacuugacgaauccgaguugcgaucuaaaaagcuguacuuauauuacacccagaugggaagagauauguauacaggcgagaaaauugaccucgauaagcuguucgacucgacccauuacgauaaagaccacaucauuccccaaagcaugaagaaggaugacuccaucauaaacaaucuugugcugguaaacaaaaaugcuaaccagacuacgaaggggaauauuuacccugucccaucaaguaucaggaacaaucccgauaucuauaacuacuggaaauauuugauggaaaaggaauuuauuucuaaagagaaguacaaccgccucauacggaauacaccucugaccaacgaggaacuaggaguguucaucaauagacagcugguugagacuaggcagagcaccaaggccauuaaagaacucuuugagaaguucuaucaaaaauccaagaucauuccagugaaagcaucacuggcuagcgaccuucgcaaggacaugaacacauugaagucucgagaggucaaugaucugcaccaugcccacgacgcguucuuaaacaucguggccggugauguauggaaucgggaauuuaccuccaaccccauaaauuacgugaacgagaaucgugaaggcgacaaaguuaaguauagucucagcaaauacuucacuagaccgaggaagucuaaagggaaggucaucuggacaccugagaagggacgcaaacugauuguggauacgcuuaacaagcccuccgugcugaucucaaaugaaagucaugucaaaaagggcgagcuauuuaacgcaaccauuagcgguaaaaaggacuacaaaaaggggaagaucuaucucccacugaaaaaggaugaccgguugaaagauguuucgaaguacggcggauauaaagcuauaaauggcgccuucuuuuuccugguggagcacacuaaguccaagaaaagaauuaggucuaucgaauuauuuccucuccaucugcuuagcaaguucuacgaggacaaaaacacagugcuggauuaugcuaucaauguauugcagcuccaggaccccaagauuaucauagauaaaauuaacuaccgaaccgaaaucauuaucgacaacuuuucauaucugauaaguacaaaguccaaugacgggucuauuacugucaagccaaacgagcagauguacuggcgcguggaugaaaucagcaaucugaaaaagaucgagaacaaauacaagaaagacgccauucuaaccgaggaagaucggaagaucauggaguccuauauugacaagauauaccaacaguucaaagcaggaaaguauaaaaauagaaggacgaccgauacaaucauugaaaaguacgagaucaucgaccuugauacucucgacaacaaacagcuguaucaauugcugguugccuuuauuucauuaagcuacaagaccaguaauaacgcuguggauuucacagucauaggucucggcacugaaugugggaaaccccguaucaccaaucugccugacaacacguaucuuguguacaagucuauuacaggaaucuacgagaagcgcauucggaucaaauga

SEQ ID NO: 3014 - RNA, 4047 nt, Artificial Sequence
  Cas9 variant
augaagaaacccuacaccaucgcccuggacauuggcacaaacagcguggggugggucguugugacugaugacuauagaguaccuacgaagaaaaugaaggugcucggaaauaccgagaggaaaacaauaaagaagaaccuuaucggugcucuguuguucgauuccggcgacacugcagaagggacccgguuaaaacgcacagcccgacguagauacaccaggcggaagaaucgccugagauaucuaaaagagauuuuuacugaagagauggcgaaggucgaugacggauucuuucagaggcucgaagauucuuucuacgugcuggaggacaaagagggcaacaagcacccaaucuuugcuaaucuugccgaugaaguugcauaucauaagaaauacccgacaauuuaucaccuucggaaggaguugguggacaacccccaaaaagccgaucuccgccugaucuaccuggcugucgcacauauaaucaaguuccgaggucacuuucucauugaagggaccuuaucaaguaaaaauaacaaucugcaaaagagcuucgaccaucuuguggauacguacaacuugcuguuugaggagcagagacuacucacugaaggaaucaaugccaaagagcugcuuuccgcugcccugucuaagucgaagagguuggaaaaccucauuucacugaucccuggccagaaaaagaccggcauauucgggaauauuaucgcguuaagccugggacucacaccaaacuuuaaagcaaauuucggucuuaguaaggacguaaaacugcaguuggccaaggacacuuaugcugaugaccuagauucccugcucgcccagauuggcgaccaguacgcagaucuguuucuugcugccaagaaccugucugacgcgaucuugcucagcgauauccugaccgaguccgacgaaauuacacgggcccccuuaucagcaaguaugguuaaacguuaucgcgagcaccacaaggaucuggugacccuaaaaacgcucauaaaggaccagcugccugagaaauaccaagaaaucuuccuugauaagacuaagaacggguaugcuggauacauugagggccaggucagccaggaagaguucuauaaauacuugaagccaauccuggccagacucgacgguucugaaccccugcuucugaaaauagacagggaggauuucuugcggaagcagcgaacauucgacaauggguccauuccucaucaaauccaccucgaggaacugcaugcuaucuuacgcagacaggagguguuuuacccauuccugaaagauaacaggaagaagauugaaucacuacucaccuuucggaucccguauuacgugggaccccuggcccgcggccacagcagauucgcaugggucaaaaggaaguuugacggcgccauucguccuuggaauuucgaggaaauaguugaugaggaggcuagugcgcagaucuuuauugagaaaaugacuaagaacgaccuuuauuugccaaaugaaaaagugcugcccaagcacucucuccuguacgaaacauucaccguauauaacgaguuaacgaaagugaaguacgcaaccgaggggaugacacggccucaauuucuguccgccgaucagaagcaggcuaucgucgaccuuuuguucaaaacuaaucgaaaggugaccguuaaacagcucaaggaaaacuauuuuaaaaagaucgagugcugggauagcguggaaauuacaggagucgaggacucguucaaugccucucuggguacuuaccaugaucuacugaagauaauccaagacaaagauuuccucgacaacccagacaaucagaagauuaucgaagauauuauccugacccuuacauuguuugaggacaaaaagaugauauccaaaagacuggaucaguacgcacacuuauucgacaaggugguacucaacaagcuggagaggcaucacuauaccggcugggggcgccuuucaggaaaacugaucaauggcauucgggauaagcagagugguaaaacuaucuuggacuuucucaaggccgauggguucgcuaacagaaauuuuaugcaacugauucaugacagcgaacuauccuucaucgaugagauagccaaagcacagguuauuggcaagacggaauacucuaaggaccuggugggaaaccucgcgggcagccccgcuaucaaaaaggggauuucacagacaaucaaaauagucgaugagcuggugaagaucaugggauaucuuccgcagcaaauugucaucgaaauggccagggagaaccagaccacugcacaggguauuaaaaaugcccgccagcgaaugcggaaguuggaggaaaccgcuaaaaagcugggcaguaacaucuuaaaggagcacccuguggacaauucccaacuccagaacgauaaacguuaccuguauuaccuucagaaugggaaggacauguauacaggagacgaucuggacauagauuaccuaagcucuuacgacauugaucacaucaucccccaaucauuuauuaaaaacaauaguaucgacaacaagguucucaccagccagggcgccaauagagguaaacuggauaacgugccauccgaagcaauuguaaggaagaugaagggguauuggcagucuuugcugcgcgcuggcgccauaucgaaacagaaguucgacaauuuaacuaaagcggagcggggaggccucacacaagucgauaaggccggguuuauccagagacagcugguggaaacgaggcagauuaccaaacauguugcucaaauccuugacagccgauucaacacugaguuugaugaccacaauaagcgcauucggaaggugcauaucauaacacugaaauccaaguuggucucagacuucagaaaagaguuuggacucuacaagaucagggauauuaaccacuaucaccaugcacacgacgccuaccugaaugcugugguagccaaagcaauccuagguaaguauccucagcuggcgcccgaauuuguguacggcgauuauccaaaguacaacaguuucaaagagcgucagaaggccacccagaaaaugcuguuuuacucuaacauucucaaguucuuuaaagaccaagaaagccugcauguuaauuccgauggggaggagaucuggaacgcuaauaagcacuugcccauaauuaagaacguccugucaaucccucaggugaauaucgugaaaaagacagaaguccagacuggaggcuucuauaaagagagcauuuuaucuaaggguaacuccgacaaacucauaccacgcaagaauaacugggauacccggaaauacgggggcuuugacaguccgacgguugccuauagcgugcuggugaucgcaaagauggaaaagggaaaagcuaagguacuuaaacccgucaaggagauggugggcauuaccaucauggaaagaacagccuucgaggagaauccuguuguguuucuggaagcaaggggguaccgagagauucaagaacauuugaucauaaaacucccaaaguauucucuguucgagcuagaaaacggacggcgcagacugcuugccuccgcuucagagcuccagaagggcaaugagcuguuuuugcccgucgauuacaugacuuucuuauaucuggcggcccacuaccacgaacucaccgguaguagcgaggacgugcugaggaaaaaguacuuuguugaucggcaucuucacuauuucgacgauaucauucagaugaucaacgacuucgcagaacgacauauucuggcuucguccaauuuggagaaaaucaaccacacauaccauaauaacucugaccuaccugugaacgaaagagccgagaauauaauuaacguauuuacuuucgucgcccugggggcuccagcagccuuuaaguucuuugaugcgaccaucgaccgcaaaagguauacgagcacaaaggaggugcucaaugcuacccugauccaccagucagugacuggacuuuacgaaacacguauugauuuaagucaacugggcgagaacuga

SEQ ID NO: 3015 - RNA, 4047 nt, Artificial Sequence
  Cas9 variant
augaaaagcgagaaaaaguacuauaucggccuggacguggggaccaacuccgucggaugggccguuacagaugaguucuacaauauucucagagcuaaagguaaggaccuuuggggcgugaggcuguuugaaaaagcaaagacugccgcggauacgcggaccuuccgcucugggcgacguagaaacgacaggaagggaguacgguugcagauauuacgcgaaaucuuugaggaugaaauuaaaaagguggacaaagauuucuaugacagacuggaugagucaaaguuuugggcugaggacaaaaaggucaguggcaaguacagccuauucaaugauaaaaacuuuuccgacaagcaauauuucgaaaaauuucccacaaucuuccaccucaggaaguaccugauggaggaacaugguaaaguggauauucgguauuacuuucuugccaucaaucagaugaugaagcgccgagggcacuuccugauagacggacagaucucucauguuacugacgauaaaccuuugaagcagcaacucauucugcugaucaacgaccucuuaaagauugagcuggaggaagaguuuauggauucgaucuucgaaauacuugcagacgugaaugagaaaaagaccgaaaagaagaacauuuugaaagagcugaucaaugcccaggauuucaacaagcaggagggcaagauucuauacucaaucuuugaaagcaucgucacaggcaaagcuaagauuaaaaauauaaucagugacgaggauauucucgaaaagaucaaagaggacaacaaggaagauuucgugcugaccggggacuccuaugaggagaaucuucaguacuuugaagagguacugcaagaaaacauaacuuuguucaauacacucaagucugcauaugauuuuguuauucugcagagcaucuuaaaaggaaaguccacccugucagacgcccagguggagagauacgacgaacacaaaaaggaucucgagauccuuaaaaaggucauuaagaaauaugacgaggaugguaagcuguucaaacagguguuuaaggaagacaacggcaacggguacgugaguuauaucggauacuacuugaauaaaaacaagaaaauuacggcuaagaagaaaauaagcaauaucgaguucacuaaguaugucaaaggcauucuagaaaagcaaugcgauugugaggacgaggauguuaaauaccugcucgguaagaucgaacaggagaacuuucugcuuaagcagaucucuuccauuaauucagugauaccacaucaaauccaccuguucgaauuggacaaaauucucgagaaccuggccaaguauuacccgagcuuuaauaacaaaaaggaagaguucaccaaaaucgagaagauuaggaagacauuuacuuuccggauccccuauuacguagggccuuuaaaugauuaucacaaaaacaauggaggcaacgcguggauauuccguaauaagggcgagaaaauccgcccauggaacuuugaaaagauuguggaccugcauaaaagugaagaggaguucaucaagagaaugcuaaaucagugcaccuaccuccccgaagagacaguccugccuaagucuuccauucuuuacagcgaauauaugguguugaacgagcugaacaaucucaggaucaacgggaaaccaauagauaccgacguuaagcugaaacuuauugaggaacuguuuaagaaaaagacgaaagugacuuugaagucgauccgggauuacaugauucgaaauaacuucgcagacaaggaagacuuugauaauucugagaaaaaccucgagaucgucuccaauaugaagucauauauagacuucaacaauauccugggagauaaauuugaauuagagaugguggaagaccugauugagaagaucacaauucacaccgguaacaaaaagcuacucaagaaauacaucgaggaaacuuaucccgaucugaguagcucccagauacagaagauuaucaaucuuaaauacaaggacuggggccgcuugucuagaaaacugcucgaugggaucacaggaaccaacauugagacgggcgaaaucgacaccguaauuaauuuccugaggaacagcucagauaauuuaaugcaaauaaucgguagucagaacuauuccuuuaacaaugacauugauaagcugcggaagaaauacaucccucaggagauuagcuacgaaguuguggagaaccuuuaugucucuccaucagugaagaaaaugaucuggcaggucauacgcaucacagaggaaauuacuaaggugaugggguacgacccggauaaaaucuucauugagauggccaagagugaagagggcaagaaaaccacaaucagcagaaagaauaaauugcucgcucuguauaaggccauuaaaaaggacgaaagggacucccaauacgagaagcuacugacuggacucaacaaacuggaugacucugaucuucguucgcggaaguuguaucuguacuauacccagaugggccgagacauguacacaggggagaaaauagauuuagacaagcucuuugauagcacccauuacgacaaagaucacaucaucccccaguccaugaagaaagacgauucaauuauaaauaaccugguucuugugaauaagaacgcaaaucagacuacgaagggaaacaucuauccuguaccaaguucuauuagaaauaaccccaaaaucuacaauuauuggaaguaccugauggaaaaagaguucauuagcaaggaaaaauauaacagguugauccgcaauacaccucucaccaacgaggaacuggguggcuuuauaaaccggcagcuagucgagacuagacaauccaccaaggcuaucaaggagcuguucgaaaaauucuacaagaaaucaaagauuaucccagugaaagccauucucgcgagcgaccugaggaaggacaugaauacacuuaagucucgcgagguuaacgauuugcaccaugcccacgacgcauuucugaauaucguggcuggggaugucuggaaccgagaguucaccuccaaucccauaaacuaugugaaagaaaaucgggagggagacaagguaaaauacaguuuaagcaaguacuuuacucguccgagaaaaucuaagggcaaggugauuuggacaccugaaaaagguaggaagcucaucguugauacgcugaacaaacccuccguccuuaucucaaaugagagucaugugaagaaaggggaacuguucaacgccaccauugcuggcaagaaagacuauaagaagggaaaaaucuaccuaccacucaagaaagaugaccgccugcaggaugugagcaaguauggcggguacaaagccauaaauggagcauuuuucuuuuuggucgagcacacuaagucgaagaaacggauuagauccaucgaacuguucccuuuacaucuccugucuaaguuuuaugaggacaaaaacacaguucuugauuacgccauuaaugugcugcaguugcaagaccccaagaucauaauugauaaaaucaacuauaggaccgagaucauuaucgacaauuucagcuaccucauuucaacaaagaguaacgacgguuccauaacugugaagccaaaugaacagauguacuggcgaguagaugagaucucuaaccugaaaaagauugaaaacaaauauaagaaagacgcuauccuaaccgaggaagaucgcaagaucauggagagcuacauugacaagauauaucagcaauuuaaagcgggcaaguacaaaaaucggagaacgaccgauacaaucauugagaaguaugaaaucauugaccuggauacucuugacaacaaacagcucuaccagcuguuggucgcauucaucucccugucauauaagaccagcaauaacgccguggauuucacaguuauaggguuaggaacugaguguggcaaacccaggaucaccaaucucccugacaacacguaccugguguacaagaguauuacagguaucuaugaaaagcguauucgcaucaaauga

SEQ ID NO: 3016 - RNA, 4047 nt, Artificial Sequence
  Cas9 variant
augaaaagcgagaaaaaguacuauaucggccuggacguggggaccaacuccgucggaugggccguuacagaugaguucuacaauauucucagagcuaaagguaaggaccuuuggggcgugaggcuguuugagaaagcagauacugccgcgaacacgcggauauuccgcucugggcgacguagaaaugacaggaagggaaugcgguugcagaucuuacgcgaaauuuuugaggaugaaaucaagaaaguagacaaggauuucuaugacagacuggaugagucaaaauuuugggcugaggacaagaaagugaguggcaaguacagccuauucaacgauaagaauuuuuccgacaaacaauauuucgaaaaguuucccaccauuuuccaccucaggaaauaccugauggaggaacaugguaaggucgauauccgguauuacuuucuugccauaaaccagaugaugaaacgccgagggcacuuccugaucgacggacagauuucucaugugacagacgauaagccuuugaaagagcagcucauccugcugauuaaugaccucuuaaagaucgagcuggaagaggaacuuauggauucgauauuugagauuuuggcagacguuaacgaaaagagaacugauaaaaagaauaaccugaaagagcuaaucaagggccaagacuucaauaaacaggagggcaacauucucaauucaaucuucgaaagcaucgugaccgggaaggccaagauuaaaaacauaaucagugaugaggacauucuggaaaagaucaaagaggauaauaaggaagacuuuguccuuacaggagauuccuacgaggagaaccugcaguauuucgaagagguguugcaggaaaacauaacccucuuuaauacucugaaaucuacauacgacuucuuaauucugcaaagcauccucaaggguaaguccacccuuucagacgcucagguagagagguaugaugaacacaaaaaggaccuggagaucuugaaaaagguuauuaaaaaguacgaugaggacggcaagcuauuuaaacagguguucaaggaagauaacgggaauggauaugucaguuacaucggcuauuaccugaacaaaaauaagaaaauuacggcaaagaaaaagauaagcaacaucgaguuuacuaaguacgugaaagguauucucgaaaagcagugcgacugugaggaugaggacgugaaauaucugcuugggaagaucgaacaagagaauuuccuguugaaacagaucucuuccauuaacucagucauaccacaucagauccaccucuuugaacuggauaagauuuuagagaaucuggccaagaacuacccgagcuucaauaacaaaaaggaagaguuuaccaaaaucgagaagauucggaaaacauucacuuuucguauccccuauuacguuggaccucuaaaugacuaucacaagaacaauggcggcaacgcuuggauauuccgcaacaagggggaaaagaucagaccauggaauuucgagaagauuguggaucuccauaaaagugaagaggaauuuaucaagaggaugcugaaccaaugcaccuaccuucccgaggagacaguauugccuaaaucuuccauucuguauagcgaauacauggugcucaaugagcugaacaaucuucggaucaacggaaagccacuggacaccgaugucaaguugaaacucauagaagaacuguucaagaaaaagacgaaagugacuuuaaagucgauucgagacuacaugguucgcaauaacuuugccgacaaagaagauuucgacaauucugagaagaaccuggagaucgcguccaauaugaagucauauauugauuuuaacaauauccuagaagacaaauucgauguggagauggucgaagaccucauagagaagaucacaauucacaccgguaacaaaaagcugcuuaaaaaguacaucgaggaaacuuaucccgauuugaguagcucccagauucagaagaucauaaaucugaaauacaaggacuggggcagacucucuaggaaacuguuagaugggauuaagggaacaaagaaggagaccgaaaagacggacaccgugaucaacuuucugcggaacagcucagauaaucuuaugcagaucauuggcagucaaaacuauuccuucaaugaguacaucgacaaauugcgcaagaaauauauuccucaggaaauaagcuacgagguaguugagaaccucuacgugucuccaucagucaagaaaaugaucuggcaagugauuagagucacagaagagaucacuaaggugauggguuaugauccggacaagauuuuuaucgaaauggcaaaaagugaggaagagaagaaaaccacaauaagcaggaagaauaaacugcuagaccuguacaaggccaucaagaaagaugagcgugacucccaguaugaaaagcuccugacugggcuuaacaaauuggaugacucugaucugcggucgcgaaaguuauaccucuauuacacccagaugggcagagacauguauacaggagagaaaauugaucuggacaaacuuuucgauagcacccauuacgacaaagaucacaucauuccccaguccaugaagaaggacgacucaaucauaaauaaccugguuuuggugaauaaaaacgcuaaucagacuacgaagggcaacauuuacccuguaccaaguucuaucaggaauaaccccaaaaucuauaauuacuggaaguaucucauggaaaaagaguuuauuagcaaggaaaaguacaaccgccugauacggaacacaccucuaaccaaugaggagcucgggggauucaucaacagacagcuggucgaaacuaggcaauccaccaaagccauuaaggagcuguuugaaaaauucuaucagaagucaaaaaucauuccagugaaggcaagccuugcuucugauuugcgcaaggacaugaauacacugaaaucccgagagguuaacgauuuacaccaugcccacgacgcguuccucaauaucguggccggugaugucuggaaccgggaguuuaccaguaaucccauaaacuacgugaaggaaaaucgugagggcgacaaaguaaaguauagccugucuaaagauuucacuagaccgaggaaguccaaggggaaagugaucuggacaccugaaaagggacgcaaacuuauuguugacacgcugaacaagcccucaguccuaaucaguaaugagagccaugugaaaaagggcgaacucuuuaacgcaaccauugcugguaaaaaggauuacaagaaagggaagaucuaccugccauugaaaaaggacgaucggcugcaggacgugucgaaauauggcggauacaaggccauaaauggcgcuuucuuuuucuuagucgagcacacuaaguccaaaaagagaauuaggucuaucgagcucuuuccucugcaucuucugagcaaauucuaugaagauaagaacacaguuuuggacuacgccaucaaugugcuccagcugcaagaccccaaaauuaucauagauaagauuaacuaucgaaccgagaucauuaucgacaauuuuucauaccuaauaaguacaaaguccaacgaugggucuauuacugugaaaccaaacgaacagauguauuggcgcguagacgagaucagcaaucugaagaaaaucgaaaacaaguacaaaaaggaugcaauucuuaccgaggaggaccggaagaucauggaauccuacauugauaaaauauaucagcaauucaaggccggaaaauacaagaauagaaggacgaccgacacaaucauugagaaauaugaaaucaucgaucucgacacucuggauaacaagcaguuguaccagcuguuagucgcuuuuauuucacucagcuauaaaaccaguaauaacgcgguggacuucacaguuauaggucugggcacugagugugggaagccccguaucaccaaucuuccugauaacacguaccugguguauaagucuauuacaggaaucuacgaaaaacgcauucggaucaaguga

SEQ ID NO: 3017 - RNA, 4047 nt, Artificial Sequence
  Cas9 variant
auggagaagaacuacuaucugggccucgaccuugggagcaauuccgugggaugggccgcuaccgaugaagacuacaacuuccugagauugaaagguaagacagcauggggcgccaggaucuuuucugaggcgaaagauugcaaggaacggcgcacuuaucgaucaaauaaacguagauuagcuaggcggaaguaccgccugguccuacucaagcagcuguucgccgaggaaaugacgaaaguugacaagaccuuuuuccuuagacuggcaaacaguacauauugggaggaggauaaaacuaaggacagcgaugggaaugaaauuggcaaaaacuugauauuuaagacccacgaggaagagaagcaauacuauacaaaauaccccaccaucuggcaucucaggaaggcccugauugagaaugacgaagaggcucuguccaaccuccgguacguguauuuagcaauccaccauauuguaaaauaccgcggaaauuuccugacugaaggugagauggggaacgauaucccuccaauaacaaccaucgaagagauuaaucagacgcuuucuuugcuggagguggacucgucagaagaugccacugacaagaccacauauaucaaaccggagagcuacaacgaacuauuuacuauucucgagaauaacaaucugaacaaggucaaaaagcagcaggaaaucgauaaacuuuucauaaguuccaaagagcgaucugagaacauuaagaauuauaucaaccuguuuaaaaccauuaucgugggaggcagcuucuccuugaagaaaaucaaugaagacacagaggacauuucaguugauuuuaccaaggacuucgaaaacagugaggcugauauaagcaaggcccucggcgacucuuuuaaucugguguuaaucgcgaaaaaguacuaugauuacauuauccugaaagaacuccuugggaagaacaaagagauauccgaggcaaugguccaaauuuacgaagaacacaaggacgaucugaagucauugaaaacgauccuaaaggaccuggauaauaaacucggaaacgacgguaaggauagaaucuauuacagcguguucaaacaggaacccacugagaaguucaaggagacaaauuaucugaguuuuguacagggcgggaaacuugaggagcugaacaaguacauuaaaaagaucuuggaaaauaacgagaaagacauugacgauaaggaaaccuauaaugcccucuacgagaaggcuuguaagggagaccuguucaagaaacaggccaacgcaugcacuucuuuaauaccucaucaauuucaccugagggagcuaaagaaaauccucgaaaaugcuggccggaaguauuccuuccugaacgauauuagcgacaaaaucaucaagauuuuuaaguuccguguuccauacuacuaugguccccuuaacaaugagucgaacgcccacucuuggguggucaaaaaggaagggcaggagaaagcgaagauaacaccuuggaauaucaacgaaauuaucgauaccccaaaaacgcgcgacaacuuuuucaagaaguugaccaauuccuguacauaccuggugggagagacugugcuccccaaaaccucacuguauuacgagaaguaucuuguccuggauagauugaauaaaaugcagguuaacggcgacuaccucagugccagcgaaaagaaugaugugcugaaauuuauuuuauccaggaagacaacuaccaucgagcagauacggacauaucugucuaagaacaaaagcaccaaggcaaaugacaucucaauuaguaacaucaaagcuacugauccuuucaaugccguaucccaugcuuuuuacggcaagcacccagaccuaaacauuaaucucugcgaggaacugaucaaauucgccacgauauacgcagaugacaagaaagaacuuaagaaguuugugagcucuaacuucaacuugacagacgaguucauuaaagaguaucugaauaccccgacuaacaagugggggcgacucucacgcaaauuucuguguggaggugaucaauuagaaauguacuaugucgacgauaauggcauccugcauaguauucuuaacaucuuggaggaaaccaaugagaaccuccaggagauacugaauaacgaaaaguacggguucaaucagaaaaucgccgacuuuaacaauacacuaaccgcugauaagacuacagaggaacaaauugaggacauccuggauagcacgcccgcgcucaugagaagguccauuauccagacccuggcagugguugacgaugugauaaaggccgcuggaaaagccccucagaagauuaugauggaagucacucggacagacggcaaaaaggaggagaccaaaucucgcuaugugcagcuuaagaagcaaaucacaaacgauaaaguauugacuucggacgaaaagaaagagcuguuaaccaaucucgaaaacaagaaaauccagcugaaggguaagcacauuuaccuuuauuucaugcagauggggaucgauuuuuacacgggcaaaauuauggacauaaaugacguuaucaacggaaaguacgauauugaccacaucauuccacagagcaugaucaaagaugacucccuggauaacaugguguuggucucaaaggacuauaaucaaaaagugaagaaggauauauaccccaucugcgacgagauuagaaacaauaugcucgauaaauggaagggcuauuacgcaaggaaaaucauuagugaagagaaguauaaccgucugaaacggaccaaggagcuaaaugccgacgaaaucaacgcuuucauaaaucgacagauuaacgucgugaauuacucuaacauccagaucaaaagaauuuuugagauaaaguauccugaaacaaagaucauuuucagcaaagccuccuuuccaucacugcucaggaaggaguacgaaaucgcaaaaaugcgcgaucugaaugacgcgcaucacgcuguugacgccuaccuuaacauugugugugggaauaucuugacuacccuguauacagauauauucuacauguuuaaggagaaaaaggaggaccauaagaacaucagcuucaauauggaaaaacgguuaauuaacuauaucgauaagaauaaccucaaagacaagauuaaaacuucuugccugagacacgaugcacuuaucaccuacaagcccgacuaugauuccggaaaguuuuacaaagagacgauauucaagaaaaguggugacaaggaaacaggccugauuccgcuacauaccaaagggccuaugagcgauacuaagaaguauggaggcuacucucagcucucccaaucauacaucaucgccguagaguauaaacugaagaacaaaacagucaagaaauuguguagggugcccacccuguacuuaaagcaguauaaaaaugaccucaacacuauugcuaagaucaugauagaugacgagaaggccaccgauauuaaaguucugcgcaagaucuaccuuaaucagaaaauucgauauaacgguugcuacuaucugaucuacacaaguaaggaaaaacagaauaaguacaagauggcauaucaaaacuacuuggacaaugacuaucucauauaccugaacaaaugucuaaagaaaauugaugagcuggacgauggggaacuuacgagccaggaguucaucgugaauaaggacggcgauaaauuucucaucgacaagaaccacaaucuggaaauuuucaagucgaucaaagagcaguauaacaagaccauuuacgauuauacuccauacauaguccaaucccgggagaugaaagaagaggacuuuaauaacuugucucugaagaaacagaucgauacauuacucaauaugauuaagauccugagccguucaaacgaacaggcuaaguucgagaccgccuuuuucgaaaacuuuacaaaaguguuccuuaagacuaugaccaucacgaaugagaaaguauacauugugaacgagaguccuuccggacuguuuaagggcaaagaagaguugauauga

SEQ ID NO: 3018 - RNA, 4047 nt, Artificial Sequence
  Cas9 variant
augaagaaauucgaggacuacuaucugggccucgaucuugggaccagcuccaucggaugggccgugacaaacgaaaaguacgacauucugagauuuaauaaaaaguucaugugggguacucacuuguuugauaugggcaacacggcuucugagaggcggauauuccgcaccucacgacguagauuaaaaaggaagaagaaucggaucgaacugcuacagacacucuuuagugcagagaugagcaaaaaggacuucggguuuuuccaacgccugaaagaaucccaguauuuuauugaggauaagacuuucaaaaacaagaauacccuuuuuauggacgagaacuacacagaucaggacuaucauauggaauaccccaccaucuaucaccugagaaaggccuugauugauaaugaggaaucugcguucgagaucaggaaacucuaccuggcuauaucgcauauccugucacaccggggacauuuucucuucgagggcgaauuaagcgacaaccuggauuucgacgauauuuuuaaugaguucgucaaguaccuuaacgaagaguugaauaucgacuuuaaaauuaagagugacguuucccugcaggccaucaaagaaauacuaacugauaagaugcucaaccgcaccaaaaagaaggagaaacugucugagcuucuggaagaggaaaagaauaaaauuuaucaagagaucuggaaguugcucguggguaacgaagcaaaaaugagcacaauuuucgacgauaaggaguacgaggaagccaagaucgcuuuuuccaaagggaauuaugacgagaaggaagaggaauacgagucaauccugggagagaaaauuuuauucguacagaaggcaaaagccauauaugauuggaugcugcuccagaacauccuuaaggaagacaaguaccugaguuauagcaaagugaaguuguacaacgagcacaaaaaggaucuaaaaauucugaaggacguccucaagaaucuggauaaaaagaucuacaaagaaauauuuucugagaacggccuuuaugaggaauaccugcgaauugagaagaaaaagaucggcuccaaagaagagaagacgaaggacaucuuguauaauagacucaaaaagauuuucgaaaacagggauaauauggcuaucgaggacauucugaacaaaauagaguuagacucauuucugccuaagcagaaaaucaaggauaauggggugauuccacggcaaguucaccagaaggaacuagagaucauccucaaaaacgccgaaaaguacuucaaauggcugauugagaaggacgaaacuggacuuagcgugagugagaaaauaaugaagaucuuuaaguucaaaauuccguauuacgucgguccccuuaauucuaaguccccuuuugcguggaucgagcguaaagaauauggcaagauucugccauggaacuucgagaauaugguggauaugagcaaaaccgcagaaaaguucaucaagcgcaugacaaacaaaugcacuuaccuccccgagaaggacguaauaccuaaaaauucgcugcuuuacaccaaguauaugguucugaacgaauugaauaaccucaaaaucagaggggagaagauuaaaguggagcugaagcagaagaucuacacagaauuauuucagaaaaacaagaaaauuggaaugaagacccugaucgaguuccuaaaaucucaaaauauagucgugacgaagguggaaauuacuggcaucgaugguacauuuaacaccucccucgggucauauauugacaugaagaaaaucuucggagaggagaagauagucaaagauaguuacaagaaaaugaucgaagacauuauccuguggauuacucuuuauggcgaggaaaagaaguugaucaaaagcaagauagaggaaaaauacccagagaagguuacacccgaggaaaugaaacugauucucaagcugaaguauagggauuggucccgguuaucuaaagaguuucugaccgaaaucgagacgauggacgaagagaccggcgagcuuaucagcauuaucgaaauguuguggcgaaagaaugagaacauuauggaacuccugucauacaaauacgauuucaguaaucgcauaaaggaguauaacgggaucaaugaaaaagagaagaacauuacauacgaggaccuagugaaggaucugcagaucuccccuagcgugaaaaagaugauuuggagagcccucguaaucgucaaagaaauaaagaaagugacuaauaagucuccgaaaaagguuuuuaucgagauggcuagggacacccagacagaaaagaaacggacugagaagcgcaaagacaagcugcuugaguuguauaaaaacauuaagaaugaugacucaaucaaggaacuggagaaaaacuuaaaggauaaaaccaaugacgaucucaagaguaaaaagcuguaccuuuauuaccugcaauugggaagauguauguauagcggugaagugauuaggcucgaggaccugaugaacgauaaucuauacgacaucgaucauauauacccacaguccaagauuaaagacgauucuuucgacaacacaguccuggugaagaaacagaucaacgccgauaagaccaaugaauaucccaucgacaaaucgauucagaacaagugcaaggcauuuuggacuagccucaaagagcguggccugauguccaauacgaaguacgagcggcuuacacgaaccgaaggguucucagacgaugaguuggcuggauuuauaaguagacaaaucguagaaacuaggcaggccaccaaaguucuggcggacuuacucaaggugauuuucggcucugauacacgcaucgucuaugugaaagccggucugaccagcgacuuucggcagaaguucgggauuuacaaauucagagagcuuaacgauuaucaccaugcacacgacggcuaccugaauaucgucacuggaaacauauauaauacacuauuuacggauaacccuuacaauuucaucaaggacaggaagaaagauaaccgcaccuacaaucucaacaagguguuugaacgagagaaugacguuuggaacccagaugugaugcuguccaaaauugagcgguauaucuacaagauucgucccuuguucacuagagcuucauaugaacagaaaggcggguuuagcgaccaaaauaucucuuccgagaaggacaagcugaggccuuuaaaaaguagcggaguacucucuaacauaaaguacgguggcuaugauaaaauuaagaacuccuacuucuuuaucgucgaauauacagagaaaaagaagcgcgugcggucaaucgaaacccugccaauuuacaucaaaaagaguauaagcacaaaagaggaccuugagaaguacuguaaagaagaacugaaguugcaggaacccaagguucucgugucgaaacugaauuauaagucccuaauuuacucuaacgggcacgaguauuacaucaauagcaaaacugccgauucaauuaccauccagaacggaauacagauuauccugacgaaggagaauuaugaaaccuacagaaaaaucuauaagaaccuugaguaccucaaacugauuuacaaggacgaaaagaucagggaggagaaaauuuuggagaagauaccgaaaauccugaagaauaacaaaaaugaucgagacuuaagugaggaugaaauuuccgagaaguucuggaagcucuauaaagaaaucuuugagaagaucaaaauuggcauauucucuaaguuuaaaagcacacugccuaucuacauugaagacugcaagaaguugaaagauuucacuacccugaacaauuaugcuaagucccgcuucauccaagagauuuugaaaugucucaacucacagcagggugaguuugacacaaaguacacucauaauuauagcaaaaaguacaacaccaagcugaguaaaucuaagauccuagaaaaugauuucuauauaaucaaccagucccccacggggcuguuugagaaaaaggucuuccuugacaaauga

SEQ ID NO: 3019 - RNA, 4047 nt, Artificial Sequence
  Cas9 variant
augggcgaggacgggaagccccugagagugaaaggaaagaccgccaucggugcuaggcuuuuccaggaaggcaacccugcagccgaucggcgcauguuucgaacaacucguagaaggcuuaaucggcgcaaauggagacugaaguuguuagacgagauuuucgauccauacauaacgccggucgacagcaccuuuuucgcgaggcugaaacaauccaaccuaucucccaaggauucacggaaggaauuuaaagggaguauguuauucccugaccugacagauaagcaguaucaccuugacuacccaacuaucuaucaucugcgccacgcuuugaugacccaggauaaacaguuugacauucgaaugguuuaccucgccauccaucacauugugaaguauagaggaaauuuccugaacagcacacccguagauuccuuuaaagcaucuaaggugaauuucgacgaucaauuuaagaaacugaacgagcucuacaccgccaucaauccugaagagucguuccagauaaacuuagcuaauucagagaagaucggccagcaguuucuggacccaagcauuaggaaauucgacaagaaaaagcaaauccccaaaauugucccugugacuauggaugacaaggcaguugauaagcucaacgguaaaaucgccagugaaauaauuaaugcuaucuugggguauaaguccaaacuggacguggccguccagugcgauccagaggacucuaacccgugggcggugaaguucgaugacgaagauauugacgcaaaacuacagaagauccuccccgagauggaugagaaucagcaaagcaucauuggaauaauccaggaccuguacucccagguaacacuuaaccaaauuguuccuaauggcaugucacugagugaaagcaugaucaagaaauacaacgaccaucacgaucacuugaagcucuauaaaaagcugauaggccagauuucugacuccaaaaagaagaccgcccucaaaaaggcuuacgaucaguauguggggaacgacggaaaagucaucgagcaggaugacuuuuacucaagcgugaagaaaaaucuggaugacagugaacucucuaagcaaaucauggaucuuauugacgccgauaaguucaugccaaaacagcggacgucccagaacggugugaucccccaucagcugcaccaacgugaguuggacgaaauuauagagcaucagagcaaguauuacccuuggcuagcagagucgaauccaaacaaacacgaucugcaccucgcuaaguauaaaaucgaagaacuggucgccuuucgcauucccuacuacguuggcccgaugaucacuccugaagaccagaagaaaucuggggcggccguguucuccuggaugaagagaaaggagcccggacagaucaccccauggaauuuugacgaaaaaguagauaggauggagucagcaaacaaguucauuaaacggaugacaacuaaggacaccuaucuuauaggcgaggaugugcugccugacgaaaguuugcucuacgagaaauuuaagguccugaaugaauuaaacauggugcgaguuaauggugauagccugaagguggcugacaaacaagccaucuaucaggaucuauucgagaacuacaagcauauuuccgucaaaaagcuccagaauuauaucaaagggaagacaggacugcccaacaauccagaaauuucuggccuuagcgaccccgaucaguuuaacaauucauugggcaccuacaacgacuucaagaaacuguuuggggauaagguggacgauccugaccuccaaaacgacuucgagaaaaucguagaguggaguacgguuuuugaagauaagaaaauacugcgcgcuaaacuuaaugagaucacuuggcugacagacaagcagaaggaugacuuggaauccagcagauaucagggaugggguaggcucucuaagaaacuguuaaccggcauugugaacgaucaaggggagcggaucauugacgagcuguggaauacuaacaagaauuucaugcagauccagucagaugacgauuucgccaaacgcauacacgaagcaaacgccgaccagaugaagaguacaaauauggaggauguccuagcugacgcguacaccagcccacaaaacaaaaaggcaauuagacagguggucaaggugguugacgauauccagaaagccaugggaggcguggcuccgaaguuuauuuccaucgaguucacgaggucugaggaccguaauccccggcgaaccauaucgagacagaggcaacucgaaaacacacugaaagauacugccaagagccuuguaaaauccaugaauccuaacaucuugucagagcuggacaaugcaagucgcucuaagaagggucucaccgaucggcuguacuuauauuuuacacagcuggggaaagacauguacacuggcgagccaauuaacaucgaugaaauuagcaauuaugacaucgaucauauacuuccccaggccuucauuaaggacgauuccuugucaaacagaguccucgugagcaaagcuguuaacaauggaaagucugccaacgugccucugaaacuauuuggcgcaaagauggggcacuucuggaagcagcuggcggaggcuggacucaucaauaaacauaagcugaaaaaccuucaaaccaauccagacacaaucuccaaguuugccaugcacgguuucauuaggcgccaguuggucgaaaccagucaggugaucaaacugguagcaaacauuuuaggcgauaaguaccgaaaugacgacacuaagauaaucgagauuacggcccggaugaaccaccaaaugcgugaugaauuuggguucaucaaaaauagagagauuaacgacuaucaucacgcuuuugaugccuaccucacagcauuccugggaagguaucuuuaccaucgcuacaucaagcugcggcccuauuuuguguacggcgacuucaaaaaguucagagaggauaaaguuaccaugaggaauuuuaacuucuugcacgaccucacugaugacacccaggcucgaauagccgauacagaaaccggugaggucaucugggaccgcgaaacuagcauuaagcagcugcgggauguguaucacuacaaguuuaugcuaaucucucaggagguguauacacugagaggggcgauguucaaucaaacgauuuacccggccucccaggcuggcaggaaaaagcucaucccuaugaaagcagacaagccagucgauguuuauggaggcuacucagggaguaccgacgccuacauggcuauagugcguauucaugacaaaaagggagauaaauauaaggugguagguguccccaugcgcgcccugaaccggcuuaauacugcaaagaacgugagcgacgcgaaauacgaucaggaauugaaggagguucugacaccucaguuuaccaaaucgaagaaaaacagaaagacaggcgagaucacucaaaccguggaagacuucgaggucguguuagggaagguuauguauaggcagcucgugaucgauggagacaaaaaguuuaugcugggcuccucuacguaccaguauaaugccaaacagcuuguacugagcgaugaaucaauuaagacccuagcuagugaggguaaacucaacgaggcccaagaauccgcagcuuacgacaaggucuaugaugagauacuggacaaggugaauaaauacuucgccuuguacgauacaaacaaguuucgacagaaacugucuuuagggaaggacaaauucgugggccuccccaaucacaacgucuuugacggaagcaagaagaucuccucaggcaaacgggaaauucugaaugagauccuuaacgggcugcaugcaaaugccacuuugggaacccucagcgauauuggcuucaguacaccauucgguaagaugcagcagccucgcgggaucggacugucuuccaacacuagcauagaauaugagucguuuaccggccuauucaaaagaacgaucuuucugaaggaccuuuga

SEQ ID NO: 3020 - RNA, 4047 nt, Artificial Sequence
  Cas9 variant
augaagaaacccuacaccaucgcccuggacauuggcacaaacagcguggggugggucguugugacugaugacuauagaguaccuacgaagaaaaugaaggugcucggaaauaccgagaggaaaacaauaaagaagaaccuuaucggugcucuguuguucgauuccggcgacacugcagaagggacccgguuaaaacgcacagcccgaccacguuacaccagaaggaagaaucggcugcgcuuucuaaaagagauuuucacugaagagauggcgaaggucgaugacggauuuuuccagagacucgaagauucuuuuuaugugcuggaggacaaagagggcaacaagcacccgaucuucgcuaaucuugccgaugaaguugcauaccauaagaaauaucccacaauuuaccaccugaggaaggaguugguggacaacccucaaaaagccgaucuccggcugaucuaucuggcugucgcacauauaaucaaguuucgcggucacuuccucauugaagggaccuuaucaaguaaaaauaacaaucugcaaaagagcuuugaccaucuuguggauacguacaacuugcuguucgaggagcagcgacuacucacugaaggaaucaaugccaaagagcugcuuuccgcugcccugucuaagucgaagagauuggaaaaccucauuucacugaucccaggccagaaaaagaccggcauauuugggaauauuaucgcguuaagccugggacucacacccaacuucaaagcaaauuuuggucuuaguaaggacguaaaacugcaguuggccaaggacacuuacgcugaugaccuagauucccugcucgcccagauuggcgaccaguaugcagaucuguuccuugcugccaagaaccugucugacgcgaucuugcucagcgauauccugaccgaguccgacgaaauuacaagggccccuuuaucagcaaguaugguuaaacgguaccgugagcaccacaaggaucuggugacccuaaaaacgcucauaaaggaccagcugccagagaaauaucaagaaaucuuccuugauaagacuaagaacggguacgcuggauauauugagggccaggucagccaggaagaguuuuacaaauauuugaagcccauccuggcccgccucgacgguucugaaccucugcuucugaaaauagacagagaggauuucuugaggaagcagcggacauuugacaauggguccauuccacaucaaauccaccucgaggaacugcaugcuaucuuacgacgccaggagguguucuacccguuucugaaagauaacagaaagaagauugaaucacuacucaccuucaggauccccuacuaugugggaccucuggcccggggccacagccgcuuugcaugggucaaaagaaaguucgacggcgccauuaggccauggaauuuugaggaaauaguugaugaggaggcuagugcgcagaucuucauugagaaaaugacuaagaacgaccuuuacuugcccaaugaaaaagugcugccuaagcacucucuccuguaugaaacauuuaccguauacaacgaguuaacgaaagugaaguaugcaaccgaggggaugacacguccacaauuccuguccgccgaucagaagcaggcuaucgucgaccuuuuguuuaaaacuaaucggaaggugaccguuaaacagcucaaggaaaacuacuucaaaaagaucgagugcugggauagcguggaaauuacaggagucgaggacucguucaaugccucucuggguacuuaucaugaucuacugaagauaauccaagacaaagauuuucucgacaaccccgacaaucagaagauuaucgaagauauuauccugacccuuacauuguucgaggacaaaaagaugauauccaaacgacuggaucaguacgcacacuuauuugacaaggugguacucaacaagcuggagagacaucacuacaccggcugggggaggcuuucaggaaaacugaucaauggcauucgcgauaagcagagugguaaaacuaucuuggacuuccucaaggccgauggguuugcuaaccggaauuucaugcaacugauucaugacagcgaacuauccuuuaucgaugagauagccaaagcacagguuauuggcaagacggaauauucuaaggaccuggugggaaaccucgcgggcagcccggcuaucaaaaaggggauuucacagacaaucaaaauagucgaugagcuggugaagaucaugggauaccuuccucagcaaauugucaucgaaauggccagagagaaccagaccacugcacaggguauuaaaaaugccaggcagcgcaugcgaaaguuggaggaaaccgcuaaaaagcugggcaguaacaucuuaaaggagcaccccguggacaauucccaacuccagaacgauaaacgguaucuguacuaucuucagaaugggaaggacauguacacaggagacgaucuggacauagauuaucuaagcucuuacgacauugaucacaucaucccacaaucauucauuaaaaacaauaguaucgacaacaagguucucaccagccagggcgccaaucgugguaaacuggauaacgugccuuccgaagcaauuguaagaaagaugaagggguacuggcagucuuugcugagggcuggcgccauaucgaaacagaaguuugacaauuuaacuaaagcggagcgcggaggccucacacaagucgauaaggccggguucauccagcugcagcuuguggaaacgcggcagauuaccaaacauguugcucaaauccuggacagcagauuuaacacugaguucgaugaccacaauaagaggauucgaaaggugcauaucauaacauugaaauccaagcucgucucagacuuucgcaaagaguucggacuguauaagauccgggauauuaaccacuaccaccaugcacacgacgccuaucuaaaugcugugguagccaaagcaauccuggguaaguacccccagcuugcgccagaguucguguauggcgauuaccccaaguauaacaguuuuaaagaaagacagaaggccacccagaaaacacucuucuacucuaacauucugaaguuuuucaaagaccaagaaagccugcauguuaauuccgauggggaggagaucuggaacgcuaauaagcacuugccuauaauuaagaacgucuuaucaaucccacaggugaauaucgugaaaaagacugaaguccagaccggaggcuuuuacaaagagagcauucucucuaaggguaacuccgacaaacugauaccgaggaagaauaacugggauacgcguaaauaugggggcuucgacagucccaccguugccuacagcgugcuugugaucgcaaagauggaaaagggaaaagcuaagguacugaaaccugucaaggagauggugggcauuacaaucauggaacgcauugccuuugaggagaauccaguuguguucuuggaagcaaaaggguaucgggagauccaagaacaucucauaaucaagcugcccaaguacucucuauuugagcuggaaaacggaagaaggcgacuucucgccuccgcuucagagcugcagaaaggcaaugaguuguucuuaccugucgauuauaugacuuuucuguaccucgcggcccacuaucacgaacugaccgguaguagcgaggacgugcuucggaagaaauacuucguugaacgccaucugcacuacuucgaugacauuauccagaugauuaacgauuuugcagagagacauaucuuggcuucguccaaucuagaaaagauaaaccacacauaucauaauaacucugaccugccagugaacgagagggccgagaauauuaucaacguauucacuuuugucgcccucggggcucccgcagccuucaaauuuuucgacgcgaccaucgaucggaagcgauacacgagcacaaaggaagugcugaaugcuacccuuauucaccagucagugacuggauuauaugagacaagaaucgaccugagucaacucggcgaaaacuga

SEQ ID NO: 3021 - RNA, 4050 nt, Artificial Sequence
  Cas9 variant
augaagcagaaauucuacgugggccuggacauggggaccgccagcgucggaugggcuguuacagaugacaaguauaacaucauuaaaagacacgguaaggcacucuggggcgugaggcuuuuuaaaacugccaauacggcggaggaacggcgcauauuccgagcugcccguagaaggacccaacggcgcaagcagagaauggagcuguugcaggaaaucuuuggggaugagauuuccaagacagacaucggauucuaccagaggaugaaagaaucuaaguauugguuugaggauaaacgggacauuaacggcaagcaacccgaguuaccuuacgcacuguucguagaugacgguuuuacugauaaagacuaucaugaacaguucccaaccaucuuucaccuacgcaaugugcucgucaacgaguggacacagaaguacgauauacgacugguguaucuugccauccaucacauuaucaagcauagagggcacuuccuguuugaaggaaagaagaugucagagguuaccgacuucggcagugcuuuugaggcauucugcaaaguggccagcgauaaugacauugaaaucacugucgacgaggaaaaguugaaagauauagaggaccuccugaaguccaggcagaaaucuaagacagcuaagaaacaagaacugggcaagauuaucgccggggcggauaaacagaagaaagcacucgccgcuuuagugaccggauguaugguaaagcugucggagauuuucgccgacaagucacuugaugacggugagcggaacaaaaucagcuuugcagauaguaauuacgacgaauacaucgcuaacguugaggaaacguuggccgagcguuuccugcuaauugcggccggcaaggcacucuaugauugggcugugcuguccgacauacuugaagggucuacuuacaucagcgaggccaaagucaagauuuauaaaaagcacggagaugaccugcgcaaguugaaaggccuccugaagaccagaccggacgaguacaaauuaaucuuuggucugcccgaaaagcaggcuaauuauuccgccuacauagggauggugaaaaagaacggaaagaaagugccuauugauaagaaaugcacaaaggcagacuucuauucauuucucaaaaagacucuuaauaaaaucaacuucgaggaugaaaaggagagggaaaucgccgagaguauuaucaaugagauugaaaacgagaccuuucugccaaagcaggucauaagcgacaauggcguuauccccuaccaauugcaugaagcugagcuagaucggauucugaaaaacgcggcacucuacuauccuuuccugucugagaaggacgaugaaggcuacacaaacauggacaaaaucaaggccaucuuuaaauuccgcauuccauauuacguggggccccuuaauaccuaucacuccgauaagggagguaacucaugggcuguacgaaagcaggacggcaaaauauacccuuggaauuuugagagcaagaucgaugccggggaaagugcaagaaaauucauuggaaggaugacgaacaaguguacuuaucugaucggcaaagacguguugccaaaggagucucuccuguacuccaaguuuauggucuuaaaugaacugaacaaucuacggauugauggugagaaagugagcguugagaucaagcaggccguguacgaaaacgucuucaaaaaguaucaacgcgugacagggaaaaagguaaaggacuuccucauaagaucgggcaucauuggaagggagcaggaacugucuggcuuugaccagaauuucaaauccucacuuaaggcuuaccaugauaucaaacagauugccggggacaucaacuugagucaaaaucagaaggaggauauaauuaaagaaaucaccguuuuugcagacagccagaagaugcugaaaaagcgucucaagauuaaauauccggagcuguccgauaaacaggugacuaaacuugcggcuaagaaauacacaggauggggucggcugucucgagaguucuuggaagaggucgaaagcgugaacaaggagaccggcgaaguccucaauaucauaucagcccugugggagacgaacgagaauuuaaugcaacugcuaaguaacaaguaugacuaccucuccgaaaucaaaagacugaacgaugaggcagaagacaagagcgaggugguuaccuaugaugacgugcagaaacuuuacguaucucccgccgucaagaggccuguguggcagacauugaaaauuguugaggaaaucucaaagauuauggggaguaagccagagcgcaucuuuguggaaauggcucgggagcccggacagaaaggcgaugucaaggugagcagaaaauccaggcugcucgaaaaguacaaauauugcaagaaggaggccccugagauauacgaaaaucugguaaaagaggacgauaacaaguuacgcucugacaaacuguuccuuuauuacacucaaaugggucgauguauguauucgaaugaagugauugacaucgaggauuuguuuaccaaccgguacgacaucgaucacauuuauccacagagcaagguuauggacgauucccucgacaaucguguccuggugaaaagagaacuaaacucaaauaagacagauguguuccccgucccgaaggaguacauggacaaagcaaagacucugugggauaugcucaaaaagaaagaccugaucaguaaggagaaauaccacaggcuuacccgccgggauggguuuucugaaaacgaguugagcggcuucauugcuagacagcugguugaaacaaggcaguccaccaaggccgugacucaauuacucacgaaggcguauccugagucagaaauaguguacgccaaagcuaaugcaguaagcgaguuucgacauaaguucggauuuacaaaaguccgcucuaucaacgacuaucaccaugccaaggacgcuuaccugaauauugugguuggcaacaccuauuacgugaaauucacuaaggaugccgcaugguucauccggaauaaccccgggagaaccuauaaucuuaagaaaauguuugagcagggaacagucuccagggguggcgaaaccgcgugggugaguggggaggacggaacuauuuucacaguuaagcgugugaugggcaaaaacaacauccuguuuacgcgcaaggccuacgaaguacgggguggguuguucgaucagcaaauaaugaaaaagggcaagggacagaucccagucaaaaauaacagcgaggacgauagacucugcgcuaccgagaaguacggcgccuauaauaaagcaucuggggcuuacuuuaugcugguggaauccgaggacaagaaaggaaacaagauuaggacucuagaguucgugccugucuaucuggccaaggaacucgaaaaaucagaggaugcagccauccgauacuguguugagaagcuggaacuuaaaaaucccgacgugcggguacgcaagauuaaaauggauaguuuguuuaacguggacggcuucagaaugcaccugagcgguaggacagggaagcaguuaaucuuuaaaugcgcugagcagcucguccuggaugaagagucgcaaaagauacuuaagaaaaccgcgaagguguucgccgacuauaaagaaaauaagaacauuaaaaucuccgauaagaucgagcugacagacgagaugcuaauuaagcucuacgaacuguuuuauaaaaaguugaaagacacuguuuacaauauacggcugucuacccaggugaagacguuagagagcggaaaagaaaaguucgagaagcucucacugcuugauaaaugucuggucaucgaagagauuuugcaucucuuccagugccagaguguggcagcuaaccuguccucuaucggcggugccgccaccgcuggcauucuaguucugaauaacgagaucagccgaugugggaagguggaaauaaucaaucaauccauuacaggauuuuacgagcaggucaucgaccuuaaaaacauuuga

SEQ ID NO: 3022 - RNA, 4050 nt, Artificial Sequence
  Cas9 variant
augcagaaguacuaucugggccucgacaucgggaccaacagcgugggaugggccgucacagaugagaauuacaaccuuugcaaauucgguggcaagagaaugugggggauuaggcuguuugacggagcucaaacugcagaagaacggcgcaugaaucgauccaaccguagaagguugucucggcagaaacagcgcauagauuuacugcaggaacuauucgccaaggagaucgcgaaaguugaccccacguuuuucauuagacucaaugaaucaaggcuguauauggaggauaagaguaccggcacaaaguuuccucuuuucgcugacccagguuacacugauaaagaguauuacaaggaauauccgaccaucuaccaucugcggcaagaguugauuaaaaaccccgaaagccacgacauccgccucguguaccuggccugucaccauauacugaagaaucgagggcacuuucucaucaacggauccuucucugauuuaaagaaucugucguuuguaugcagagagaugcuugacgcauucaacgaguugucaaaguaucagcugaugauuagcgauaucgacgcccuagaaaagauucucagugauaggaaacagcagaaguccgcuaaagugaaggagcugguccaaaucuuugaaugugugccucgggaggacaaaucugacgcaaagauaugcaaagaaauucuuagcaaucuguguaaguucuugguuggcgccaagggcaacaucacacgucucuuugauaccgacuucgaugagauggagacuuccucauucaguuuuggggacagcaaauacgaagauucucuguuaccaucccuggaggaaaauuaucccgacuacgcuaacgugauucagaagaucaaagccauguaugauuggucaguccucguggagaucauggcgggagaaaauuaccuuagcuucgcaaagguaaacgccuauaaaaagcauaaggagaaccugaguauuuugaaaucucuaaugaagaaauacugcacaccugacguuuaccagcgcuuuuucuaugagaccgaugaaaaguccagcuacgguaauuauauaggcgcuauccacaacaaugggcacucgcauacgaugaaaaagugugacgaggaaacuuuuuacaagucucuguccaaaauucucgauaagcuggugguccagaaaaccgaccaagacacacuugagauccugaagaaagaagccaagaaccagacuuugcucccacuggcaagaaccaaggcuaauggagugauacccaaccagauucacauccaagaguuaagggccauccuggauaaugcgaaaacauaucuaucauuccucaacgaggccgacgaauacggcaccauugcagagaagaucauucggauagcuaaauuuaagaucccuuauuacgccgguccacugaguacgcgacauaaagaacagggggcuaauacuuggauugugcgcaagcaggagggaagaaucuacccguggaacuucgaggaaauggucgaucuugagaggagcaauaacgaauuuauccggcgcaugacaaauaaaugcaccuauuugauuggcgaggacguucugcccaagaacucccuccuguacucuaaguucauggugcuuaaugaacugaacaacuugaaaauaagaggccacaagaucagcguagagcucaaacaggagcuguauaaggaauuauuuuguaaaaaggccaaggugacugggaaagcacugcuagucuaccucaagaaaaaggaugccgagcugacacuugaagacauuucaggauucgaugcugacuuuaaaaguuccuugagcaucuauauugauuucaagaaucacauccugagggagcaaauagacgaugguaaguaccagucuaucguggaaaacauuaucaaauggaagaccauuuucgacguugauucaaaaaugaucgagaagcucauagcgcgugaguauccuaauauguuuaguagcgaacagauuaaaaagaucugccggcugaagugucgaggcugggggaacuucuccucuagauuuuuaaauggaauacagggcgagaacacggaaaccaaagagugcuucacaaucauagaagcacuguggaagacuaauuacaaccuuaugcaauugcucucgaaacaguuuaccuucaaggacgccaucgacugcauuaaugcugauaaaguggguaagaucgacaaagucacauacgagaacacugugaaggaucugguaguuagcccagccaauaagagggcaauuuggcagaccgugcagaucacagaggaaauuaaaaaggucaugaaaugugagcccgaaaagauuuuuguggagauggcccgcgggggcgagaaagaaaagaagcggaccaucuccagaaaagagaggcuacugaagcucuauauggacuacaaagaugaaaaccgcgacuggaucaaggagauugaaucacgagaugagcaagacuucacuaaucggaaacuguaucuuuacuauacgcagaucggacguugcauguacaguggcgaggaaauuucuuuggaggaacugaugcagaagaacagcaagugggauaaagaccauauauauccucaguccaagaucaaagaugacucauuagauaaucucguccuggcuagaaaggacauuaacaacaauaaaagcaacaaacuucugccaacagggauccaagacaagaugaaaaaguacuggaaaauguugcucaaguacggauuuauuucuaaaaagaaguaugauaggcugaugcgcaccgaggacuucuccgaugaggagcuaagugguuuuaucgcccggcagauaguggagacuagacagagcucuaaagcaguugcggaacugcucgagcaccugaaugaacauaccgagaucguguacguaaaggcugaacuugucuccgacuucaggcacgauaacaauauguugaaaucacgacgcauuaacgacuaucaucacgccaaggaugcauuucugaauaucgugguuggcaacguguacaaugccaaauucacagcuaacccccggaauuggauuaagaaaaacagaaauaccaacuauaguaucaggcgugucuucgacuacacugugaagcgcgggagcacaauaguauggcaaggagugaaggauggcggucacucgauugacgggaucaaaaagacgauggcccggaaugauaucuuauauaccgagagaacuuacugugagcagggcgaacucuuuaacgcaacacugauuaaaaagggaaacccgaaugcuauaggccuuaaaaaggggcuggacccuaugaaguacggagguuauuccucucccaaaaccagcgccuucgcguuuaucgaguucgacggcaagaaagggaggcagaaccaucuaguugaaauuccagucuacaucgccaauauugcugcacgacagccugaguauaucaagaaccaccucgaggagaaaaagggauaccaaaaugugauagugaagaaauaucccauccagaagaacgcccugauuaaauuggauggcuacccagcucggcugcgcggugccaaugaaaagucaaucacacucaaaaacgcaguccaguuaguucugaagcccgaauaucaugagacuauuagaaauguggaaaaguaccuugaguacaucgacaaagaugagaguguguccaaggcggccagguuuucucacaccgaacuggacaaauuguaugaugagcucugcuucaaggcugaaaacagcauauacaaaaagcggccugccaaucaguccgcaacgcugaaaaacgggcaaaagaccuuucuagcuauuacaaaucugaaggagaaagcccagguaaucaacaauaucauuacuauguuccgaugugacgcaaccacaacuaccaaccuuaagacgaucggcggaucagccaaugcuggcgggaugcaggucaacaaaaacacacucaccagccagaaggugguucuggugcaccaaaguauaacuggauuguuuggcacagaagaggagcuguuauga

SEQ ID NO: 3023 - RNA, 4053 nt, Artificial Sequence
  Cas9 variant
augaagaaacccuacagcaucggccuggacauugggaccaacuccgugggaugggccgucguuacagaugacuauaaggugccugcuaaaaagaugacuguacucgguaauacggauaaaucucacauaaagaagaaccuucugggcgcauuguuauucgacucagggaauaccgccgcggauagaaggcugaaacggacagcucgccgacguuacacuagaaggcggaaccgcauccuauaucuccaggagauuuuugccgaagagaugaguaagguggacgauagcuucuuucauagacuggaagacuccuuccuugucaccgaggauaaaaggggagaacggcacccaaucuuuggcaaucuggaggaggaagugaaguaccaugagaacuucccgacaauuuaucacuugcgccaauaccucgcagacaaucccgaaaaaguugaucugcgacugguguaucucgccuuagcucauaucauaaaguuuagaggucacuuccugaucgaggggaaguuugacaccaggaacaaugauguccagcggcuuuuccaggaguuuuuggcaguguacgacaacacuuucgaaaauucuucgcugcaggagcaaaacguacagguugaagagauucuaacagacaaaaucucaaagagcgccaaaaaggaucgugugcucaaacuguuuccuaaugaaaagaguaacggacgcuucgcugaguuccuuaaacugauugucggcaaucaggccgacuuuaagaagcacuucgaguuggaagagaaaaccccacuccaguuuuccaaggauacguacgaagaggaacuggagguguuacuggcgcaaaucggcgacaacuaugcagaacucuuccuuucugccaaaaagcuguacgauagcauauugcuauccgggauucugacugugaccgacgucucaacaaaagcuccccucagugccagcaugauccagagauauaacgaacaucagauggaucuggcacagcuuaagcaauuuauuaggcagaagcugucugacaaauacaaugagguuuucuccgaugugucaaaggacggauaugcugguuacaucgauggcaaaacuaaccaggaagccuuuuauaaguacuugaaagggcuccugaauaagaucgagggaagcggcuacuucuuagacaagauugaacgggaggacuuucugcgaaaacaacgcaccuucgauaacgguaguauaccucaccagauccaucuacaggagaugagagcgauuaucaggcggcaggccgaauuuuauccauuccucgcagacaaucaagaucgcauagagaagauucugacauuuagaauccccuacuauguagggccucuugcuaggggaaaaucugacuucgccugguugucccguaagagcgcugauaaaaucaccccauggaacuucgacgaaauuguggauaaggagucgucugccgaggcauuuaucaaucggaugacgaacuacgaccuguaucucccgaaucagaagguccugcccaaacacucccuucuguacgaaaaguucacuguguauaacgaguugacaaaaguuaaguacaaaaccgaacagggcaagacugccuuuuucgaugcuaauaugaaacaggagauuuuugacggcguguucaaggucuaccgaaaggugacaaaagauaagcucauggacuuucuggaaaaagaguucgaugaguuuagaauaguagacuuaaccgggcuggacaaggaaaacaaagcguucaaugcaucauauggaacguaccacgaucuaaggaagauccucgacaaggauuuucuggacaacaguaaaaaugagaagauucuugaagauaucguuuugacccugacacucuucgaggaccgcgaaaugauccggaaaagacuggagaacuauagcgauuuacugacuaaggagcaagugaaaaaguuggaaaggcgccauuacaccgguuggggccgacuuuccgccgagcucauucacgggauacggaacaaggaaucucguaaaacaauccuggacuaucuaauugaugacggaaauagcaacagaaauuuuaugcagcugaucaacgaugacgcucucucauucaaggaggaaauugccaaagcacaggucaucggcgagacugauaaucugaaccagguggucagugacauagccgguuccccugcuaucaagaaagggauucuucaaucauugaagaucguggacgagcugguuaagauuaugggccaucagccagaaaauaucgugguagagauggccagggaaaaccaguucaccaaucagggacgccggaacucucaacagagauuaaaaggccucacagauucaauaaaggaguuugggagucagauucugaaagagcaccccgucgaaaauagccaacuucagaacgacaggcuguucuuguacuaucuccagaauggacgagauauguacaccggugaggaacuggacaucgauuaccuaucccaguaugacauugaucauaucauaccucaagcauuuaucaaggacaacucuauugauaaucgcgugcugacuucgagcaaagagaaccggggcaaguccgacgauguuccaucagaagacguggucaacagaaugaggcccuucuggaauaaacuccugaguucugggcuuaucagccagcguaaguacaacaauuugacgaagaaagagcugacaccggacgauaaggcgggauuuauuaaacgccaguuaguggagacccggcagaucacuaagcacguagcuagaaugcucgacgaaagguucaacaaagaguuugaugacaauaacaagcgaauacggcgcgugaagauuguuacccugaaauccaaucuugucagcagcuucagaaaggaauuugagcuguauaaagugagggaaaucaacgauuaccaccaugcccacgacgcauaucuaaaugccguggucguuaaggcucuccuggugaaauacccuaaguuggagcccgaguucguguauggcgaauacccaaaguacaacucuuaucgggagcgaaaaacagccacccaaaagauguuuuucuacuccaauaucaugaacauguucaaaaguaagguaaaacuggcagaugaccagauugucgaaagaccuaugaucgaggugaaugaugaaacuggugagauugcuugggacaagacaaagcauauaacgaccguuaaaaagguguuaagcuauccccaggucaacaucgugaaaaagguugaggaacagacuauugggcaaaauggcggacucuuugaugacaacccaaaaucuccccuggaggugaucccuuccaaacuuguaccacugaagaaagccuugaacccggaaaaguacggcggguaucagaaacccacaaccgcguacccuauucuccugaucgucgauacaaagcagcuaauaccaaucucagugauggacaaaaagcgcuucgagcaaaaucccgugaaauuucugaaggacaagggauaucagcagauugagaaaaacaauuucgucaaacuuccuaaguacacucucguugauaucgguaacggcauuaagaggcugugggccaguagcaaagaagugcacaaggggaaucaguugguagugucgaagaaaucccaagaccuguuauaccacgcucaucaccucgauaacgacuauucuaaugaguacgucaagaaccauuaucagcaguuugauauccuguucaaugaaauaaccagcuuuucaaagaagugcaaacuuggaaaggagcacauucagaagaucgaagaggcauacaguaaagagcgugacuccgccucuaucgaggagcuggcugauggcuucauuaaguugcucgguuuuacgcaacugggggccaccagcccauucuccuuucuaggcauaaaacugaaccagaagcaguauacagggaaaaaggacuaccuucuccccuguauggaagcaacucugauccaucagucaauuaccggcuuguaugagacacggaucgauuuaagcaagcugggaggagacuga

SEQ ID NO: 3024 - RNA, 4053 nt, Artificial Sequence
  Cas9 variant
augggcaagaacuacuaucuggggcucgacaugggaaccagcuccguggguugggccgucacagaugagaaauacagaauccuuagggcuaagggcaaagaccuguggggaguucgguuguucucugaagcaaagacugccgcggagcgccgaacgcaccguaccucaagaaggcgguuagaucgcgaaaaagcuagaauugccugccugaaggagauguuugcagaagagauaaauaagaucgaccccggguucuaucagaggcuaaacgauaguaaauacuuucucgaggacaagaaagaacaucaaccuuaugccauuuucgcugauacaggcuacacugacaaggaguauuacgaugaauacccaaccaucuuucaucugcggaaagcacuucugaauauugagaacgacaagaagaaauaugaugugcgcuugguauaccucgccauccugaauauguucaagcaccgaggucacuuucugaacgcuaaucucgacgauaaaagcgggggaaacuuaaaggaguauauagaaaugcugcaucaguccauggugaauauccuuaacauuaauuugaaaaacgucgagaucgaaaagauugagaaaauccugaagucuacacaguacagcaauucagaaagacuagagaaccuccuggagcuuuaugaacugagcaagaauaaaaacaagauagagaccgaaauuuucaaauuuaucuguggcuugaagggcacuauuaguaaaaucuacguggaggacaaguucgaagacgaguuugccaagaugacacucuccuucagggauucuaacuuugacgagaaaaucauugaaauagaggauaaucuggacgaugacaaguaugauauguucuuacugaucaaacagauucacgacuggagcguucucgcgaacaucaugaauggggaagaguaccuuuccguggcacgggucaagcuguacgauaaacacaagaaggacuuggaaguguugaaaaaguauuacaaacaaaacucaauggaggaguauaauaagauguuccgucagaugaacgauggaaauuacagugccuauguagguagcguuauauacaaagacaacucugugcgcagaggcugcaaguccaagaaagaagacuuuuauaagaauauucugaacaccaucaaaucaugggaggauugugaagcuaaggaguacaucacgagcgagauugacaaagggaauuuccucccgaagcagaucacugccaguaacggagucauucccaaucaggugcauaaaaaggaacugaagaaaauacuuaagaacgcaucugaguaccugaauuuucuaaacgaaaaagaugaguccggcuauaccaucagcgaaaagauugugaaacucuucgaguuucaaaucccuuacuaugucgguccaaucgcuuacaacauugggaaugacgagucgaagcacaggcauaacauguggucuguucggaaggaaaaaggacccauauauccuuggaauuucgagcagaagaucgauauuaaaaaguccucagaaaaauuuauccgaaaccugauuaaucacugcacauacuuaaacgacgaggaagugcugccaaagaauagucuacucuaugagaaguucaugguacugaacgagcuuaauaaauugaagaucaacggcgagaaaauaagcguggaacugaagcagaauaucuuuaacgaucucuucaaaaagggcaagaaagucacuaagaaagggcugauuaaguaccuuaaagaacagggagagaucgacaauugugaagagguggagauuuccgguaucgauggcgacuuuaccaacaagcugucuaauuacaaaaaguucgccgauauauuugggguucaaucguugacauaugaacagaccgacauugcggagaacaucauucgcuacucaacgaucuauggagauaguagaaaguuccucgaagagaggauacgggaggaauacuccaacgugcuggacgagaaacagaucaagcgcauuuuaggcaugaaauucaaggacugggguagacugagcaaagaacuacucgagcugucuggggucgauaaggaaacuggcgagaucgccucagugauuaguaggauguggaaugacaacuauaaucuuauggaguugaucgcaacagaacguuuuagcuacgcuuaugagauagaacaacgguccaagaaacuggagaagaccauuucuacuaucgaauacgaggaucucgacgagcuguacaugucgacacccguaaaacgaaugguuuggcagaccaucuuagugcugaaggaacuugaggaagucuugggaugcccuccaaaaagaauuuucguggagauggccagggaugucaacgcuccgaaggaccgcaaggauagccggaaaaagaaacuccuggaacuauauaagaauuguaaaaaggaggagggcgacugguccaaggaacugaacgccagagaggaaucagaguuuaaaaguaagaaacucuaccuguauuacaugcagaaggggaggugcauguauucuggaaaacccaucgaucuuaagaauuugcugaacgacaauuuauacgauauugaccacauauauccucgccauuucgugaaggaugacagcaucgagaacaaucucguucugguggagaaaaacuuuaaugcacacaaguccgacaacuacccaauugaaaaugaaauccgacagaaaaugcauucaauguggaagaugcuucgggaugguaacuucauuacggaggaaaaauacagccgucugaucagaaaggaggaguuuaccgacgaugaaaaagccaaguucauaucuaggcaaaucguagagacacgccagggcacuaaggucauuaccgacuuguuugaacagacauuccccgaguccgauaucguguauguuaaagcugggaacgugagugaauuucggcacaaguucaaacucauuaaguguagaaaugucaacgacuuucaucacgcgaaugaugcauaccugaacaucgugguaggaaauguguauuacacuaaauucaccaagagcgcccuaaacuucauaaaggacuauaaaaagaauccugagaaaaacaaguaccacauggaucauauguuucaguauccaguuucuaggggcggugucgacgcuuggauuacaaaaggggccgaguccaucucaauggugcgaaagaugauggcaaagaauacccccauggugacucgcaugaacuacgaaaaacacaguggccaaaagggaggcaucagcgaucagaauauuugcucggccaaaauagcuaagaaaaacgucuaccugccgaucaagaugggggacgagaagcucaaaaauguugaaaaguauggagguuacggcucccugacggccaaauauuucuuucuuguggagcauacaauuaagaaaaagcggaucagaaccauugaagcauacccuauguauuuggacgcgcugaacaaagagaauaaguuacucaacuacugugugcagguacuggaguaugaugaacccaagaucauaauggagaaaaucaaggucaaaucucuuuucaagauuaauggguacuacuauuaccugaacgcuaaaagcgugaacaggaucauuuggggaaaugccacucagcuauuucucgaaaacgacaucaaugaguauguucguaagauaucaaagaacauugagugcaucgauaucaauagugaaaacaauauuaaaguguacgacaucuucauagagaaguauuccaacaaacuguuuucuaaucgcuugggcaaccugaaggaagcaauuauccaaaaucggaacaaauucauugaguuaaagaucaaugaacagauaaacgucauucucgagcuggugagauacagccaggaugguguuuauuccaucaaucuuucacagcugggguugagcaguaccuacgccaucaacaggacaucuaaggagauuuccaaaaugaaggaaugcaaacucaucaaccaaagcgugaccggccuguacgagaaugaaauugaccuacugacuguauga

SEQ ID NO: 3025 - RNA, 4053 nt, Artificial Sequence
  Cas9 variant
augcagcaauacuaucugggcguggacauggggagcgccuccgucggaugggcuguuaccgaugagaaguaccagcucgugagaaagaaggguaaagaccuuuggggcguaaggacauucgauaucgcacagacugccgaagugcggcgcgucucucgaacgaaccguagaaggcagaaucggcgcaagcaaaggauucagauacugcaggaguuguuaggggaagaggugcugaaaaucgacgcgggauuuuuccacagaaugaaggaaucacgguauguugcugaggauaagcgcacccuagacggcaaacagguggagcuccccuacgcccuguuugucgaucaagguuucacagacaaggauuuuuauaaacaguucccuacuauuaaccaucuuaucguguaccugaugaccacaagugacaccccagauauucgauugguauaucucgcacugcacuacuacaugaagaauagagggaacuuucugcauagcggagacaucaaugauguuaaagacauacaguccauccucgaacaguuagagaacgugcugaaggaauaugucgacgauugggagcuuucuuugaaggacaaaguggaugccauuaaggagaucuacaauaaagaccugggcaggggcgaacggaagaaggcuuucauuaacacucuaggggugaagacaaaaucggcaaaggccuuuugcucacucaucagcggagguaguaccaaucuggcugagcuuuucgaugacuccggccugaaggaaucugaguaugccaaaauagaauuugcgaacgcaaauuucgaggauagcgucgaggggauucaagccuugcucgaagaccguuuugcuguuaucgaggccgcaaagcgccuguacgauuggaaaauuuuaacggacauccugggagauaacgcuucccucgccgaagcgagagugaagucauaugagacucaccaugaacagcuuguagagcugaaaaguuucaucaagaaguacuuggacaggaaaauuuaucaggacauauucaucaauccgaacauugccaauaacuaccccgcauacgugggccacaccaagaucaacgguaaaaagcaagagcuagaagucaaacgggcuaagcgaaaugauuuuuaugccuacauaaagaaacaggugauugacccuaucaagaaaaagguuagcgauaaagcugugcuggcccgccucgcagagaucgaaucucugauugaggucaacaaguaucuuccacugcagguaaauuccgacaacggggugauccccuaccagauuaaguugaaugaacucagaaggauauucaacaaucuggagaaccgguuaccuguucugaaagagaaucgcgauaagaucauuaaaacauuuucauauagaaucccauacuaugugggaccccuaaacggcgucaauaggaacggcaagagcacuaauuggauggugcguaaagaaggggaggaaggaaagaucuacccuuggaacuucgaggagaaagucgaccucgaagccagugcugagaaguuuauucggcgaaugaccaauaaguguacauaccuggugaacgaagauguucuuccaaaauauucuuugcuguacuccaaguaucucgugcugagcgagcuuaacaaucugagauuggacgguaggccgcucgaaguaucggucaaacaagagauauacgagaacguguucaagcgcaaucggaaaguuacccugaagaagaucaaaaacuauuuacugaaggaaggcgugauuucugagaaagaugaacuauccgggcucgcggacgaugucaagucaagucugacggcauaccacgacuuuaaagagaaacuuggacauuugacucugacagaagaucagauggagaagaucauucucaaugugacccuguucggcgacgacaaaaaguuacugaaaaagagacuugccgcuuuguaucccaacaucgaugagaaaagccucuccaggauggccacuuuuaauuaccgcgacuggggucgacugucuaagaaguuccuaagcgaaauaacaucaguagaucaggagaccggggaacugcggacgaucauucagugcauguacgagacccaaaacaaucucaugcagcugcuuagugaaccuuaucacuuuguggaggcaaucgagaaagaaaacccaaagguugacuuggaguccauuagcuaccguaucgucaaugaucuguaugugucucccgccgugaaaagacagauauggcagacauuacucgucauuaaggacaucaaacaaguuaugaagcaugauccuaaaaggauuuucaucgaaauggcucgcgagaagcaggagucaaagacuaccaaaagucggaaacaggugcugagcgaaguguacaaaaacgccgagaaguauaaaaaucuuuuugaaaagcugaacuccuugacagaggaacagcucagaucuaagaaaguauaccuguauuucacucaacuaggcaaguguauguacaccaaugacgcaauagauuucgagaaccuggucucggcgaacagcaauuacgacaucgaucacauuuauccacaguccaaaacaaucgacgauucauuuaacaaucucgugcugguuaagaaaggaauuaacaaugacaagagugacagguaccccaucgauaagaacauacgagacgaugagaaagugaagacccuuuggaauacuuugcugucuaaaggcuuaauuacgaaggaaaaauucgagcgccucauccggagcacaccguuuuccgacgaggaacuggcuggguucaucgccagacagcuugucgaaaccaggcaaucaacuaaggcaguggccgagauucugagcaacugguuuccugagucugaaaucguuuauuccaaggcuaaacacauuaccaauuuccgucaggauuuugagauacuaaaggugcgcgaacucaacgacugccaucacgcccaugaugcauaccugaauaucguagucggaaacgcuuaucacacaaaauucaccaauagucccuaccgguuuauucagaacaaggccaaucaggaguauaacuugagaaaacuguuacaaaaggcgaagaaaaucgaaagcaacggugugauugccuggaucggccagucugagaauaacccagggacuauagcuacagugaagaaagucaucuccaggaauacgguucucauuucacgaauggugaaggagguagacggacagcuguucgaucagcaacuuaugaaaaagggcaaaggucaggugccuaucaagaguagcgacgaucggcugauugacaucucgaaguacgggggcuacaacaaagcaaagggagccuauuuugucuucauaaaauccgugcgcagaggcaagaccauuaaaucuuuugaauacauccccguucauuuggcuaagaaguucgacuguaaucucgagcugcuaaaagaauaucuggagagcgagaaggaucuuaacaauguggaaauccucaugccaaaagucaugauuaacucacuguucaauuacaacgggaguuugauaaggauccccggacgguaugacaagaaaucccuguuaauuaauguggauguuccucuccugcuugagucucagcacaucaagcagcugaaggugauugaaaaauacauguauaagaaacgagucagcaagaacuccaauaucuugcucacuaaauuugccucagaccaacugaaggaucuagacgcacuguucgauguacuuagcuacaagcucaacgagaauauauacaacgugaucaaugacaaauaugauaagcugguuauuugcagagacaaauuuaucaguuuggauacagaagugaagugugagaugauuuucgaguuacugcaccucuuucagugcaacucucagcuggcgaacaucaccaaaauaggugccacauccaaguucggcagcauuucgaugucuaaaaaucuuaaggaaaacgacaagaugucaaucauccaucaaaguccauccgggauuuuugagcacgaaaucgagcugacugcuuuguga

SEQ ID NO: 3026 - RNA, 4053 nt, Artificial Sequence
  Cas9 variant
augaagagaauccugggccucgaccuugggaccgccagcauuggaugggcucuggugaacgaguccgaaaaugagaaagaaaagucugagauaaucaaauugggugucaggguuaaccccuuaacaacugaugaacagacggacuucgagaagggccggccucugucagugaaugcagaucgcacccuaaaacgaggggcccguagaaaccuccaaagguuuaagcagcggcgcaagaaucugauugagauccuuauuaaaaagggauucaucacaaacauaagucuguugacugaaaucggcagcaauaccacauaccagacccucgagcugagagcgaaauccguaaaggaaaagauugagaaggaggaauuugcuagggugcugcucacuaucaacaagaaacgggguuauaagucuucgcgcaaagccaagaaugacgaggaagggucauuaauugauggaaugagcgucgcaaaagagcuguacgacaacaaucuuacagugggccaguauguuuaccaauugcuggaaaagggcgggaaauauaucccagauuucuaccgaagugaccuacagaacgaguuugaugugauauggaauuuccagaaggaguuuuauccgaacauucucaccggagaacuguacaagaaacuucagggucaaggccagcaaaauuccagaaagcuguucuuggccauccaccagauuuacacggcugagaacaaagggaagagggacacugucaaaaagcagcauuauaaguggcggaacgaugcaaucaauacccagcuccugaucgaagagguggccuacguauuaguugaaauuaacaauaaccugaauaaaucuagcggauaucucggcgcuauauccgaccguucaaaggagcuuuacuuuaacaaagagacagugggugaaaaucuguauaagcagauccaagagaacccccagacuagcuugaaaaaucaggucuucuaccgccaggauuaucuagacgaauuugagcaaauuugggaaacccaggccaaguucuacagcgagcugacaaaggagcucaaagaagaggugagagacguggucaucuuuuaccagaggaagcugaaaucucagaagcaccuuauauccgaaugcgaguucgagaaacaucacaaggcgauuccuaagucaagcccacuguuccaagaauuuaaaaucuggcagaucuugaacaauauugaguucaagcauaaaaagaccaaagaacucaagauccugagugaggaauuaaaagagacgcuguuugaggaacuaaacauucgggggaauuucacuucugaugcaguucucaaguuugugaagcuggacaaaaaggagugggaacuuaacuauaaaaagggaauagagggcaaucgaacaaacgaaguauuguacaacguguaucagaaaaucgccgaguacgagggcuauggguucgauugguccaaaaagagcgcugucgaaauuaaagaggaacugaauaccaucuuuucggagaucggaauuaacucuaagauacucgacuucaaucccgaaaucuccgguaacgauuuugacaaacaggagucauaccaacuguggcaccuucuguauagugccgaggaagauggcuucuugaagcagaaacuccaggacaaguacggguuuaagagcgaguacgcaaauaugcuggcuaacguguccuuccagucugauuauggaaguuuaucagcccgcgcgauuaaaaagauccugccuaaucuaauugccggccacgaauuuagugaggcauguucccucagcgguuacaaccauucuaauucacugacuaaagaggaacuugcuaacagaccauugaaggggaaacuggagcuccugaagaagaauaguuuaaggaaccccguuguggaaaagauccugaaucaaauggucaaccuugugaaucagguaauagagagcuauggcgaaaucgacgagguucggauugaguuggcccgcgaacucaagaaauccgcucaggagagagcccugaugacaaccaacaucaacgcaucuaagacgaaauacgaaucguucaggaagcuacugcaaaaagauuucggaauuaagaauccuacccguaacgacaucauaaaguaucggcucuacgaggaacugaaagccaauaaguaucacacaauuuacacuaacaaauacaucccacgagacaaacuuuuuagcaaagagauugauaucgagcauauaaucccgaaggcuaaguuguucgacgauuccuuuucaaauaaaacccuggcguucagaaagcccaaccaggacaaaggcaauaugacagcaauugauuauaucuuaaguuaccagucuaaggacauugauaacuauaaaagcaggaucgaaaaucucuuuaagaacgggaagggagacauauccaaagccaagcgcaauaaacugcuuauggaggaaaaggauauuccugacgguuucaucgaucgggaccugagaaacucacaguacaucgcuaaaaaggccaagcaauugcucgaggaagugauuaggacugucaauaccacaaccggcagcgugacuaacaaacugcgcgaugacugggggcuaaucaaugucaugcaggagcugaacaugccaaaguuuaaagcaauugacgagucucucauagaacagaucgagaagaaagauggaacguucaagacacgaauuaaggacugguccaaacggaacgaucaccgucaccaugccauggacgcucugaccguggccuuuacuagauauaaucacauccaguaccuuaacaauuugaacgcaaagagugauaaaaagggcgcgauuuaugguauccaagaacuggagaccuacguuaauagcaaagggaagaggaaauucauaaagcccaugcauaacuuucgcgaggaagcuaagaaacacaucgaggacauuuuaaucucuuucaaggccaaaaauaaggugguaacaaagaacauuaauaagaucaaguccaaagauggcuuuauaaagaaaguccagcucaccccucggggacagcugcauaaggaaacuguguacggcaaaauuaacgagguuguggucaaggaagagaagaucaaugcaaaauucgaccuugagaagaucaacaaagugacaaagccaauuuauagaaaugcccugcuaaaaaggcuccaggaguucaacggggaacccaagaaggcuuuuacggguaaaaauucacugaguaagaacccgauauacuuggauguagcccaaaccaaaacucugccugaaagcgugaagguucaguucuuugaggaaaauuauacaauccgaaaagagauuucgcccgacuuaaagaucgauaaaauuaucgacaagggaauacagcgcauccuccugaagcggcuugaugaguucaacggcaaaccaaaggaagcauuuuccaaccuggagaaaaauccuauuugguugaacaaggaaaaagggaucgcuauuaagagagucaagaucaaaggagugaagaauguggagucucuccacaacaaaagggaccaccugggcaaugaaauacuacaaaaggguaaaagcgcccccaacgacuacgucucaaccgggaauaaccaucacguugcgauuuaucaggauaagaauggcaagcugcaggagaaaguggugaguuucuacgaggccguagcucgugucaacaauaaacuuccaaucaucgaccaggauuuuaacaaagaccucggauggaaguuccuguuuacaaugaaacaaaaugaaauguucguguuucccuccgaggauuucaagccuuuggaaacugaccugauggauaagaaaaacaauucuaagauuagcaaaaacuuauuccgcguucagaagcucggcaacaaagacuauaccuuucggcaucaccuggagacgaagaucgaggauauaaagaaacuuagagacuucaccuacauuaggaagcgaaauccagaauccaucaaaaacauuaucaaggugcggauaaaucaccuggggaacauuguccaugugggagaguacuga

SEQ ID NO: 3027 - RNA, 4056 nt, Artificial Sequence
  Cas9 variant
augagcaagaaauacuaucugggccucgacaucgggaccaacuccgugggaugggccgucacagaugagaauuacaaccuuugcaaguaugcugguaaaagaauguggggcauuaggcuguucgaagggggagagacugcagaacagcggcgcauaucucgaucaaaucguagaagguugagucggaagaaacaacgcaucgacuuacugcaggagcuauuugccgaagagauugcgaagauggaucccacguucuuuaucagacucaacgagagcaggcugcaccuugaagacaaguccaccggcgagaaauucccucuguuucgggauaaggacuacacagauauucaguauuacaaagaauauccaacuauguaccauuugcgcaaggagcucaucgaaaauucuaaaguucacgacauacgacugguguaccuggcuugucaucacauccucaagaacagaggucauuucuuaauuaaugggucguuuucagauguaaagaaacugagcagugugugcgaauccaugcuuaacucuuucaauggaaucagcaaguaucagauugagaucaacgacauagaaagguuggaggaaauucuguccgaucggaaaaagcaaaaaucagucaaggccaaagagcuaauccagauuuuugaguguggcccgugcgaagacaagaccgaugagaagacauguaaagcaaucgugaguaaucucugcaaguggcugaccggccuuaaagggaacaucaauagcauuuucgacaugcaguuugaagagauagacacuucuuccuucucauuuacagaacccaaguacgaggauaccaucagcgccgcucuggaggaaaaauauccugacuacgcagauguuauucagaagaucaaggccguguaugacuggagugucuugguggagauaauggcuggagaagauuaccucucuuucgccaaaguaaacgcguauaauaagcacaaagagaaccuguguauuuuaaaggaaguuauccguaaauacugcgacuccgagaucuaccacaaguucuuuaacgguuucgaugagaagaauggcuaugggaacuacauuggaagcaucuauaaaaauggccauucguacgcaaugaagaaauguucuacggaagacuuuuauaagacucuggguaaaauucucgauaagauacaaccagagaaggaagacgagaacgugcuugaggaacugaaagucgaggugaagaaucagaccuugcuaccccuggcccgcacaacugcuaacgggaccaucccuaaucaggugcacauucaggaacucagagccauccuggauaacgcaaagaaguaccuuccauuccugaaugaggaagacgaguauggaacagucgcugagaaaaucauuuccauagccaaguuuaggauccccuacuacguuggcccuuugucaacccggcauaaagaacaaggcgcgaacaguuggauugugcgaaagcaggaggggcgcaucuauccauggaauuucgaagagaugguagaccucgaacagagcaacaaggaguuuauucaaagaaugacgaauaaaugcacuuaccugaucggagaggauguguuaccgaagaacucccugcuauauucuagguacaugguccucaaugaacugaacaaccuucggauacgcgguaauaaaaucagcgugaaguugaaacaggagcuguauaaggaacucuucuguacaaaggccaaaguuaccggcaaggggcuguuuaacuaccuuaaaaaggaggacgaagaacuggcauuggaggauauuucaggauucgacaucgauuuuaaaaguucccucacuagcuaucuggacuucaagaagcagauuuuaggcgaggagaucgaaaaagauaaguacaaagguauaguggagaauauuaucaaguggaaaacaauuuacgacgaugacucuaagaugaugaagaaaaugaucgagagagaauaucccaacgucuuuucaaaggauaaaauaaagaaaaucugcagguucaaguacaguggguggggcaauuucagccuguccuuucuaaacggcauucguggagcugaccgggagaccggggaaucuuucacgaucauugaggcccucuggaaaaccaauuauaaccugaugcagcuuuugucgaagcaauuuacauuccgagaagagaucgaucugauaaaugcugagaaggugggaaaaauuaacaagguaagcuacgacaauacuguuaaagaccucaucguguccccugccaacaagagagcaaucuggcagaccguccagauuacagaagagaucaaaaaggugaugaagugcgaaccagagaggauuuuuauagaaauggcccgcgguggcgagaaagagaagaaacggacugucucaagaaaggcuaggcuguuagaacuguaugcggcauguaaagaugacgugcgcgauuggaccaaggagaucgaagaccgagaggaacgggaguucaauaguaagaaacuuuacuuguauuacacacagauggggcguugcauguacucuggagaggaaauuaacaucgaugagcucaugcaaaagaauagcaaaugggacauugaucacaucuauccccaguccaagauaaaagacgauucacuggacaacaugguucuagccaagaaggugaucaacaauagcaaacagaacaagcugcucucuuccgauauuagaaucaaaaugaagaaauacuggaaugcucuguauaagggcaacuuuauuaguaagaaaaaguacgacaggcuuacccgcacugaagauuucacgaaugaggaguugagcgguuuuaucgaacggcagauaguagagacaagacaaucuuccaaagccgucgcagaacuguuaaacaggcucuaugagcacucagaaauuguguacguuaaggccgggcuggugagugacuuccgacaugacaauaaacuucugaaaagccgccggaucaacgauuaucaccaugcuaaagacgccuuuuugaauaucgucgugggcaacguauacaaugcaaaguucaccucgaacccuagaaaguggauuaaagagaauaggggaacuaacuacuccauacgucgcguguuugauuauaauguuaagcggggcaacaccgucguguggcaggggguggaggacggaggucacucuaucgaugaaauuagaaaaacaauggcgaggaacgacauccucuacaccgaguauacuuacugugauaagggcgaacuguucaaugcuacacuaauuaaaaaggggaacgacaaggccaucaaucugaaaaaggcacucgauagcgucaaauauggaggcuacaacucaccaaagacgagugccuucgcuuuuauagaguucgacgguaaaaagaaggaacggaaaaaucauaucguugagauucccguguauaucgugaacauugccaagcgacagccggauaccaucaaagaguaccuggaacagaagaaaggguacaagaauguagucgugaagaaauauccuauaaagaaaaacgcacuuauuaagaucgacggcuacuuggcucgccugagaggagccaaugagacugacaucuuacucaaaaacgcgguucaacugauucuuaaugauaaguauuacgaaaucauaaggcggguggagaaauaucuggaauacaacguccgauaugaggccgaguccauguuugaaggcuucgaccacgcugaucuaaauucucucuacgacgagcugacaagcaaguuggaaaccuccauuuacaagaaaagacccgcaaaccagcugaaugccuuagagaaggggaaagagaaguuuaaaaacauccagacacuccgcgaaaaggcucaaauuaucaaggagaugcugauaauguauaggugcgaugccgcaacuguggcgaaucuuaaagccauuggaggcucagcuaacgccgguagcaugaagaucaaaaagaacacccugacgagucguucuuugguucucgugaaucaguccaucaccgggcuguucgaaacagaggaggagcuaguauga

SEQ ID NO: 3028 - RNA, 4056 nt, Artificial Sequence
  Cas9 variant
auguacaagaaauauggcaucgggcuggacauuggaaccagcuccauagguuggucuguggucgaugaguacggccacaucauuagaguuaaggggcagacaggacucggcgugaggcuuuuccgggaaggucaacccgccgcugaccgccgaacuuuucguacgaccagaaggcggcuggggcgcagaagguggcgguugcgcuuacugcgagagaucuucgauccuuauauugcagcccaggacccaaacuuuuucgcgagacagaaagcuagugccaucgcaccgggagauaguagguuuaaggccguauaccggcuauucaaugaccagacagaucgucaauuuuaugacaaauaccccacuguguaucaucuccgccagaagcugaugaccgaaaagagacaguucgauauaagggagaucuaccuugcuguccaccauauugugaaauaccggggccacuuucugacaggcggggcagccaagaacuucaaaccuggaaaguuggaccucaauaccuauuuugcuacuaucaacgcccagcuggcggcaauuuucauggauagccaaguugaacugccacagcucgacugggaugccguggucuccuuacugacaaaugaccaggagucucccucggaccgacagaaagcucuuaccaagauguugguggcccaaggugaugcaacgcagaagcgcuuuuacacugaguucucaaaagcucugcuaggccucaaggccaaacuguauguacuuaccggguucgaaggagacaagacagaucagaaagcgcugacuuugagccucgagacccuggacgaucaucaagacgauguuacacaguuacugggcgacgaacagagacagcucguggagcuucuggccaggguccaaagugcaauccaguuggcuauaauuaucccuaacgguaagaccuuuuccgggcagauggugcagcaauaccagacgcacuaugaucagcuacggcugcucaaagacuaccgcgagcagcugacugaucaaaagcacagaagggcccuuaagcaggcuuaugccgacuaccuggcaaaugaccaggaucaggacgccuuggugaaagcugucgaaaagguucucaaacaaaaccagccacugucuacagugggaguacguuuacagaccgcgauugaugcaggcgacuuccugcccaagcaacggacuaaagccaauagcgugaucccucaucagauccaccagcaggagcuagaucgaauuauagaagcucaauccgucuacuauccauggcucgccgaggaaaacccgguggcagcccauagaucauacgcucccuauaagcuggacgagcuuguugauuuuagggugccuuacuaugucggcccauuggugcagccccaggccgacaaggcagcgaaagagacaaaguucgcuuggaugacccgcaaagaagcccagaguacgaccccuaucacaccauggaauuuugagcaagaaguagaucggaacgcaagcgccaaugcuuucauucagagaaugaagacuaccgacacauaccugcucggggaggauguucugcccaaaaacucucuucuguaucagagguuugaaguguugaaugagcucaacaacguccgcguggacggaaagcuguuaacuaucgccgagaagcagcgacuguuccaagaucuauuugucgaccggucccaggcaucagugaccauagcucagcuccaagccaaucugauugcgcacggugccgcuaaagaccguguugaaaucaagggccuugcagauccgaaaagauucuugagcagucugacaaccuaccacgacuacgcccagaucauuccugaggcucucgaacagcccgauaagagggccgacaucgagaaaauuauaaacuggucuacuaucuuugaagauacguccauuuucaaggagaagcugcaggagaucgcaugguuaacaccagaccaacgccggcagcugagccagaaaagauauaggggguggggacagcuuucggauaaguugcucacccaacugcgagacgcgacuggccagucugugauggaucuacuguggaccgaaccuaauaacuuuaugcagaucauucgccggacagaguuccagcaagccauagcuagaguaaaucagaccgaccucaaacagcaggaucuggccacuacaaucaacgaccuuuacacgucaccccaaaauaagaaagcaauuaggcaggucuugcuggugguugcugauauccagaccgccaugcaugaaguggcaccaucaugguuauucauugaggccgcucguggucccgagcaaaacccuaagcgcaaacucgcgcggcagcagcagcugcuugaagccuauaagacuucagcaaaggagaucgucaaugaagcugugaaagagaagcuguugagcgccauagacgaccaccaaaaauuugaagaucagguagugcucuacuuccagcagaacgggcuggacauguauacaggcaagccacuagauuuugagagacuguccaaauaccauaucgaccacauuaucccgcaaucuguugucaaggaugacagccucgauaauagggugcugaccacacccgaggaaaacgagcgaaagggagcccgggugccuggcccacuuuaugcuucacagcaggggcgcuggagauugcugcagagggcaggauuaauuagucaacggaaacucgaccaucugcuucugcgacccgaggaacuagaucagcaggccacugguuucgucgcgagacaacucguugaaacccgccaggugaucaagcugauaacgaauauuuugucccagcaguacgacccugagcaaaccaaacuggugagcguaaaggcuggcuuaucucaccaguuuaggacacgucucaaccugccaaaacuucgggagcugaaugauuaccaccaugcccacgacgcauauuuggccgcuagaaucgggacuuaccuccugcagagguaucccaaccuagaacgcuucuuugucuacggacaguaucaaaagacccgauucgaccugaagagacauuuuaacuucauuggcgagaugcuuaaagguaagccggaagaugcagugaucguuaaagccccucacucagagacagugauaugggacaagcaggaugaagucaaacagcucaagaagaucauggaguaccggcaccuguuggugacucaugagguuuaugacaaucacggggcgcuguuuaaccagaccauucauccagcuaaaaaucccaagaacaggaaauuaaucccucgcaagacgacacaaaguaccgaacucuacggcggauacagcggcgagacuacaggguaucuggccauugcacguaccgugacuaaaaauaagaucuccuaccagguacuuagaguccccacccggcuggugggaagguugcagcgaucuucggaaagcgcccagcgccaaauacucacagauugguucgcuccauccuuugugucaagagguaaacagcagccuuucgagauuguccugcggcacguuuucaagaaccaaacggugaucgacgauauccaugagcagagucacagguuuggccuacgcucugacaccuauuacugcaaucagcagcaacugguacuuagccucgaacagcagagaaugauuaucgaucagaagcugaacaauacuaacaaauugaugguggucuaugaggccgugugugaccaaguugcaaaguacuuccccuuauauaggaugaaucacuuuaaagaaucccugcucgaggcugggccaaagcuggccgaacuuccgauuaacacagugcaguccaaaaauggaaagcugaaguugggccagcggagcguccuacugcagaccaugcaaggucuccaugcgaacccugagacaaaagaucugucuauaaucgggugccccaaguacuucggcaaacuucagguguccaguggaauuaaguuaacugagaaugccguucugauccacgaaagcccaaccggccucuuucagcgucgcgugcgauugucugaccuguga

SEQ ID NO: 3029 - RNA, 4056 nt, Artificial Sequence
  Cas9 variant
augaagauccugggccucgaccuugggaccaacagcauuggaugggccguggucaaugaggcugaaaacgagagagaauccucuucaauaaucaggcuggguguucgggugaaucccuugacaguagaugagcagaacaauuucgaaaaaggcaagccuauuacuacgaacgcagaccgcaccuuaaaacgaaguaugcguagaaaucugcaaagguacaagcuacggcgcgccaaccucgugagccugcuuaaaacacagggguggaucacugaugagacccuguuguccgagcagggaaauaacucuacauuugaaaccuauagacucagggcggaggcugccacuaaggaaauuacacuggagcaguucgcacggguccugcucauguuaaauaagaaacgcggcuacaagucgucacgaaaaaugaagcacgacgaggaugguagcuuugugaacaaucuggacaucgccagagaacuuuaugauaguggguugaccccaggacaauacgcuuauaaccugcuaaaagacggcaagaaguacauaccggauuucuauagguccgaccuccaggaggaacuggauaaaaucugggcauaccaguacgaguaucaugaaaauauucuuacgcacucucugcggagcgccaucauugaccaguccaagacuggcaccacaaaaaucuuuuugaagacucaugggauauucaccgcugauauuaaaggaaaccguaacgagcgcaauaagcaacucuuugagcugagaugcggugccuuagaaagggcgcugacagcagaggaacucgccaccguuaucgcugaggugaacggccagauuaauucaaguagcggguaccuuggagccaucucugaccgguccaaagcacuguucaucaaccaccagacggucggccaguauuugaugcaacagcuagaccgagaucccaauaagucacugaagaaccagccuuuuuaccgccaagacuaucucgaugaauuugagcagcugugggagacucaggcucauuaccacccagaacuuacagccgcgcugaaacacgagauuagagacauaaucauuuucuaucagaggcggcuaaagagccaaaaauggcucguggccaauugucccuucgaacaucgcaagguaugcccuaaaaguucuccacuguuucagcacuucagaaucuggcagguuuuaaacaaugugaccgucacuguggauaacaagacauacgugcugaaugaggaacagaaguccauacuaagcaaagagcuccuguacaaggagaaaauuucgaagagggacgcacuuaaaauguuguucgucaaggcuaaggguguugauaugaacuuugccucucuggaaggggaccguaccauguccaaucuccugaaagcugcccaagagaucgugucaaucaguggacauggcgauuaugacuucggcaagaugcccgcagaugacauucacaacaucauucggagcguauuugggggacuugguuucgccacggacuggcugaauuuggauaccgacgcugaugaccucgaacaggagucccagaugcgacuguggcacuuaauauacucuuuugagggcgauaacagcacaacuggggacaccaaacugguggaaagacuaaugucacuccugaaccuuccucaggaguaugcgagguuguucgcaaauguccaucuggaagaugacuacuguggaaucaguuccaaggcccucaaacgcauucugccauuuaugaaggcuggccacaucuauagcgaggccugcgcauuagccgguuacaagcauucugaacaaucacugacacgggaggagaacaaaaauagaccgcuuaaggaucacuuggaacagcuccccaaaaacagucugaggaauccugugguugagaagauccuaaaccagauggugaaugucgugaacagcauuauagacacuuaugggcgcccagaugaaauccgaauugagcuggcucgggaacucaaaaauaacgcccugggccgucaggcaaucuucgaggcgauuaauagaaacaccaaggaguccgaaaggauccaacagauacuuaaaaaggaguuuggauugacacauguaucucgcaaugacaucauucgguacagacuguaccaggaauuaucgggcaacggguauaagacccucuacagcaauaucuauauuccccaagagaaacuguucuccaaggaaaucgauauagagcacauuaucccucaggcuaggcuuuuugacgacucauucaguaacaaaacucuggaguaccgagauguuaacauuaagaaaucuaauacgacagccaucgacuuugugcgcaacgaauauggagagaaugaagucgagcaguacaagaagcgggugaacgauuugcucaaaagcggugcaauaucccaggccaaggcuaaaaagcugaaaaugaccgaggccgaaaucccaaaugacuucauugagagagaucuaaggaacacucaauauaucucacguaaggcacaggaaaugcugcgcgacgucgcucgggugguuaccgccacaaccggcagcgugacugauagacucaggcaggacuggcagcugguagaugucaugcaagagcuuaauugggacaaguacgaacgacagggguugacaacggugauuaacggacgggauggccagcagauccgcagaauaaccgacuggacuaaaaggaaugaucaccggcaucacgcgauggacgcccugacaauugcuuucaccaagcccgcauacaucucuuauuuaaaccaucucaaugcccgauccgaggacgauaucagaaguauugagcgcagguuucuggaacgugacgcuaacggucaccuucgguucaucagcccgauugcccacaauuuuagaucugaggcaaaaaggcaucuggaaaugauauugguuuccaucaaggcgaaaaacaagguggucacacgcaauaacaacacuaccaagacgaaagggggccgaagaaaucggauucaacucaccccuaggggacagcugcacgaugccacaguguacggcucaaucuugcugccccauacuaagaccauugcuguagacgggaaaaugacagccgagaucauaggacaggugcaaaacccaguuuuccgccaggcauuaagucagcgucucgaggcuugugguaaugauccuaagaaagccuuuacuggcaagaacagccuggaaaaagcacccgucuggaucgaccaggcccacaccgagcaugugccagcugaagugacgauucaaagacuugagccccagcacacaauccggagggcggucaauaaggaucugaacauuaauaagguuuuggacaaagggauccagcacauacuccaggcccgccuggaugcauauggaggcgacgcugccaaggccuucgcuaaccuagauaauaacccuauuuggcugaaucaagaaaaagguaucgcaaucaagcgagugaccacugccgagaacauuucgggggaaccacuucaucacaaacaugacaaggagggcagaccgauacucgacacaaauggaaagcccaugccuuccgauuuugugcggcugaugaacaaucaccauguagcgaucuuccaggacgcugauggcaacuugcaggagcacauugucucuuuuuacgaagccguggcaaggguuaccgagcugggguuaccagugaucgacaaagaauauaauaaggauaaaggauggcaguuccucuuuacucugaagcaaaacgaguacuucgucuuucccaacccugcccagggcuucaauccagacgagauugaucuuaccgacgaacgcaacuauagcagaaucucacccaaucuguacagggugcagaaaaugaguuccaaguacuauguuuuccggcaccauuuggagacaacgguggaagauaagaaagagcuccaggguauaaccuggaagcguauccaaucucugaacaaucuaaaagggauuguaaagguccgcaucgaccacauuggacgaaucgugcagauaggcgaauacuga

SEQ ID NO: 3030 - RNA, 4056 nt, Artificial Sequence
  Cas9 variant
auguucagccagcaaaacaaucuguacugcgagucccucucuaaguuguauuacaacaucaccaaaaauuuucugucaaagaacgaaguguguagaauuuaugagauauucuuuugcaguaucuugacauacuucuuaaagaaguauaaucacgacauuuuuaaaaagagcuccacuaugaagacgauccugggccuagaucucggggucaccucuauuggaugggccguuaucgugacagacgaugacaacacucccauaaaaauccuggguaugggcucgaggauuaucccucuuucaaccgcugauaaggaagaguuccagaaagggcaggcaauuagcaagaaucagagucggacaaucgcccgcacccaacgaaaaggauacaaccguaagcagcugagaaaggaagaguugaaaaagauacucggcgagcuggguauuacuccauccaaagaacugcucaauuuaccgucuaucgagcuguggaaacuuagggcggacgcugccagcgggaacgcacccuuguccgccgaacagcugggacggaucuuuuauaugcuaaaucagaaacgcggcuacaagucagcuagaagugaggcaaaccaagauaaaaaggacacagauuacguagccgcugugaagggcaggcaucagcagcucaaagagaaggggcagaccauuggacaacacuucuauacggaaaugcugacucuugaggaaaauagcggucauuuucaggucaaaaacaauguguacccucgggaggccuaucuggaagaguucaacgcgaucauugcagcccagaagccacaacacgcuuuucuuaccgacgauguuguggaccgccuccgagaugaggucauauucuaccagagaaaacugaagucucagaagggcuuaguguccaucugugaauuugagggguucgaaaggacauucuuugacaacguaaaacagaaggacaaaacuauuuucaccggacccaagguugccccuaaaucaagcccacuguuucaacucugcaagaucugggagacagugaauaacauaaaucuuaaggucaaaaacaccgauggcaguaagaauaaaugggcagacuaugugcccacgcuggaacagaagcaggagauuaucgagcauuuguucaaaaacgcugguaucucucuagaugcccugcggaagauucucggguuuaauaaggacgaaaucuucgugaacaaacagauugagaagggacugcaaggcaauacuacauacgcggaaauacacaaaauccuuggcgauuccaagccugagcuguugggguuuaacauuaauaucgaaccaagcaaacacucggcccuccuggucgacaagcguaccggagagaucuuagcagagaaagaaggucagcagguuucugcugagauugaaaaggagaacuucuaucagcuguggcauacuauauacuccaucaaggaucuagacgagugugccgcugcccucauuaaacgcuuuaauaucgauccgaacguggcagcccaacuggcuaagauugacuucucaaaaggcgcguuugggaauaagaguaacaaagcaaugagaaagauccuucccuacuugaugcagggauauaacuacgccgaugcuugcagccuggccggcuauaaucacuccgacucucagacaaagaaagaaaaggaggaaaacguaguggacgauaaacucaagcugcuugagaaaaauagccugaggcagccugucguggaaaagauaaucaaccaaaugauucauguugugaaugcaaucauugacaaguacgguaaaccagaugagauccgggucgaguuggcccgagaccucaagaaaucaaaggaugaacgcaacgaggcugaacugcagaaugccaguaacaaaaaguuaaaugaggaaguggcaaacagacugaaggagcuagggcuccccguaaccaaaagguucguucagaaguauaaauuuauauucccugugcgggaccgcaagauuaaagaggcgcaacuggucaaucaguguaucuacugcggcgaaacguucaacgugaccgaggcucuuuccggagauaauuuugacgucgaucacauuaucccaaagagcauguuguucgacgauucucagacaaacaaagugcugguucacagaaaguguaaugccaaggacaaaucaaacaagacugcauaugauuuuauagccgcuaaaggcgaaaacgagcucgccaucuaccuggacaggguggacgauugguucaagcgugggguauuaaguuacggaaaaaugcagcggcugaaggucagcuaugaacaauacgcagagcgaaagcagcuuaaaaaggagaccgaagcugacauuaaauugugggagaauuuuaucgaaagagaucucaggcagacacaguauauugccaagaaauccaaggaccugcuaaagaaaaucugcaacaaugugacuguuaccgaggguaagauaacagcgcaacugcgcaaccucuggggcugggaugacgugcugaugaaucuucaguugcccaaauacaaggcccuggggcagaccgagauuaaagaauggacuucugagcauggacggagauuacacaagaaggaagagaucacgaacuggacaaaaagggaugaccaucgccaccaugcuaucgaugcacucgucguggccuguaccaagcagggcuucauucaacgaaucaauacucugaacucgagcgacaccaaagaugcuauggaccgggaaauuaaggccgcaaaagagaaguauaaugagcuuuacgauaagaaacuguugacagaaaccaacgagcagguaaagaaucacacugaacguuuuaacaaacucgagacauaucugaagucccagcaaccgccucuauucacgaccagauacguggaacaggaggcggacaaaauauuuguuucauucaaggccgguaaaaaggcugccacuuacgggaucaggaagauuaaaaaggacggcaaaaaggucguggugcaggagaaaaucgucguuccccgcggagcacugcacgaacagaguguguauggcaagauuaagacacaagagaaagauaagccacucaaauaccuguuugaaaauccugagaccaucguggacaaccggauaaagauccuuguaaaagaaagauuggauaaguucgagggggacgucaagaaagcucugacaucuuuaaagaaagagccccucuuuauugauaaugaaaagaacacucugcuugagaaagccgcaugcuauaccgacgccacggugcugaaguacaagcuacaggcucucaaagcgaaccagguuaaugauaucguggacgaaggagucaagaggauugugaaagcccgacuggcacagcauaagaacgagaaagaggcuuucaaggauaccguuugguucaaucaagaaaaacgcaucccaauagugagcguacgggucuuugccagacccgacgccuccaaguuggcuauuaucaagacagaugagaacaauaaaccuaucgguuucgcacugacuggcaacaaucaccauauugccauauauaaggacaacaccgggaaauuagugcagcacaucugcacauuuuggucagcgguggaaaggaagaaauucggagucccaacuguugugaagaauaccggcacgcucuggagcgagcugcuucacaaggaccugccggguacauuuuuggauaaacucccccaggacgggcuggaacuagaguacucucugcagcaaaacgagauguucguacuuggccucccuaaggaauccuuugaggaugcuauuaaaaauaacgaccugccauugcugaguaagcauuuauaucucguguggagcaucucugauaaugacuacugguuccgucaccaucuggaaaccaaaaacuccgagcuuaagucaacuacaggagccaaggaaaguaaacgcuacuaucgguuucagagcgucggcaccuucacuaaggagaaucccauuaaagugcagcugaaccacuugggggagaucaccaagauaggagaaccuuga

SEQ ID NO: 3031 - RNA, 4059 nt, Artificial Sequence
  Cas9 variant
augaagaaaagaaacagggaggaauacuaugugggccuggacaucgggaccagcuccgucggaugggccguugcuacacccgauuaccggauuccuaaguuccgcggucacaaaauguggggcucucgacucuuugcagaggggaagcgugccgcggaaagaaggcaguuccggacuaaucgcagaaggcuugcucggcgccgagacagacugcaaauauuggaggaauuauuugccgaggagauggcaaaaguggauaacacguucuuuaugaggcugaaggaaucaaaguucuuucuagaggacaaaaccguaaaggaaaaacauauccucuucaguacagauaaguuugacgccgaucgguucuauaaagacaauccaacuauuuaccacgugcguaagcgccugauggaggaggaaccgcaggauaucagagagcuuuuucuggcuguccaucacauuuugaaguauaggggacauuuccucuuugcaggcagccuggaacagaacggugccuccaucgaggaacuggugcggacccucuuagggaaacagggacuggcuauacuugacgauacaaucgacucuaaugagaugguuaacauuuugaagaauaccggcgagacuaaaucggaucgaaagaaagacgugcaagaacuguggaacccccuaaaggacaaagucaagaaggcccaggcggcagagauggccggccucgugcuggggcuuaaaucagauaucagcaagcuguucgcuaauagugacuacaaagauuuggacuccucuauuaagaacaucaauuucagcuccggagauuaugaagagaaacgcgacgauuacgccaacucaauaggugacgauauuguacuccuggacacaaugaaggcauuauacgauacccugauccucagucagauucuucagggcaagagaagcaucucugcugccaaaguugaagacuauaauacgcacaaggagcaacugagggcguugaaagccauccuaaagccucacaaacggcuguacaacgagauguuucgcgaaaauaacaagaaggaccucuccaacuauguggcauacauuucaagcuauagugaggggaaaagagucaauagggaaggauucuacaaguaugugcaggcugugcugaaacaggucgaugacucugauuccaagcaggccauacuugaggcuauccgucuggaaacuuuucuaccacuccugcggguuaaagacaacgccgugauuccccaucaaauccaccaggcagaguuagaggccauacuggaaaccgcucgaaagaaguacaauuuccuaaacgauguaagcgacggcgugucggucaaagauaagauuauccagcucuuuacauucagaaucccuuacuauguggguccacugaauccccauucuggggagacuguugcggacaggaaacaaggaaccggcugggugguccgcaagcagcggggcaaaguguacccuuggaacuuugcagauaugguagacguuaaggccuccgcugaagccuucauuacaaaucuuaccaacaaaugcacguauuugaucggggaggaugugcugccaaagagaucacuccuguacagugaguuuaugcuucugaaugaauugaacaugauuaaguaugacggacacgagcucccggucgcaauaaaacagcuguacaucgaacagguguucaagcaagagcacaaaaagcagacuaaagguagggucuuagauuuucugaagcgcaauggccuaauuacagggagcgccaccgcugugaucacuggaauggacgacgccaucaagggcgaucuccaguccuaucgagacaugguucggauuuucggugcaggguuugaucauucuauggcggaacguauaaucagaugggugacacuguucggcgaggcuaaagacauucuugagaacaagaucagggaaguauacggaaauagcauuucagauagucagaugcgcgccaucaaaaaguugaaauacgcagacuggggccggcugucccaagccuuccucauagcugucaaggggugugauaagagcggaguggagagaaacaucauuaccugccugagggccucuucacagaauuuaauggaaauccugagugaccaggguacguauauuaaacagaucaaggcauggaaccaccaacauaccacaaacaugauggauacucuugacuaccaguugguugaugaccucuauguggcucccagcgucaaacgauccauauggcagucucuguguauuguggaggaauugguaaagaucaugggccaggccccuaaaaagauuuuuguggagguuacccgcacaaagcaagcggagaaaacuaagaaagauucgcggaagaaaagacuggucgaacucuacaccgccaucgggaaggagggagcugcauggaaaaaggaaauagaggcccaccaggcuggcgacuucaggcguaagaaacuguaucuuuacuauacacagaugggucgcugcauguacagcaaugaaccaaucgccauggacgcauuguuuaccuccgcguacgauauugaccauaucuauccccaaucacugacuaaggaugggaguugggacaacuuagugcucgugaaaucucagcugaauaaggagaaaagcgaucaguacccucuucggccagccauuagagagaagaacaaggcucacuggcaguaucuguguagggccggcuucaucuccgaaaagaaguacgagcgauugaugcggacgacagaacucaccgcagaggagcugucaggauuuauagcucgccagcuagucgaaacuagccaggccaccaaagcaguuacaggccugcucgagagaauuuauaccaauacugaaaucugcuucgugaaggccgagacagugucucaguuuaggcaccagcauaacuucaucaaaauucgggaacugaauaacuaccaccaugcuaaggacgcguaucuuaauaucguagucgggaacguguaccacgagaaguuuacgaaaaaucccugggaguucauugcccgauccaccgaaagacgcccguacaacuugaauaggauguaugauuuugaccuguuaaagcaaggacguguuauauggcaagugccuaaaagucucgagacuguccaggcaaugaugaaaagcaacgaugugcggaucacuaaaaagcugcuuguucagaagggugaacuguacgacgcuaccauuacaaaagcccacaaggccaaagagggcacuuauuucccccuaaagggggcugaugcaagacucagggacgugcaucgcuacggaggcuaugagaaaaucaagauugccuacuauucuguauuuuccugucgagaaaaggcgucaaauaccauccacacgcugauaaucccaauuccugucuacaaagcugguuugcugcaaaccgaggccgacuuaacagcauacgccuggcagacuaagcagaaaaccaagcccaucaaagauauuuauagugcuaucacaccaauauacaagaaacucugcauuaacacuguggugaagaucgacggguucaaguauuuccugggcggaaaaaccggcgauuacauguggcuugaccccgcaaucccugucguucuggaugaacaagccgcggcuuauuugaaggccauuagcaaaguggggagagcagacgauguagagaacacggcccaggcuauagaccucaucacagccgaagcaaaugaggcuuuuuacgaugugcugcuaaagaaaauggaagccaagauuuucgcgaaggccuaucagaccaucgucgagaaacuggcaucggagacugcucgggaaagguuucgcgagcuuuccauuggagcccaguguucuugccuccuggaaaucuugaaccuguuagcuaauaacaagacaaccuucacauuuuucaaagacaagaugggcgugaccaugagccguagaaaacaaccaauggaucucacaaagcuggaggaguguauaguuuacgaaacgucaaucaccggucuuuacgagaaggcagugagucuguuguga

SEQ ID NO: 3032 - RNA, 4059 nt, Artificial Sequence
  Cas9 variant
augggcaagagauaccacaucgggcuggacauuggaaccagcuccauagguugggccgugauggaugacgauuucaaaaucaugagggucaagggcaaaaaggggauuggaguucggcucuuugaggaaggcaaaacagcugcagagcgccgaggucaucguacuacgagaaggcgguauucucgcagaaaguggaggcuuaaccuguuggaagagaucuucgaccccgaaauugccaagguggauccuaccuuuuucgcgcgguuaaaagagucaaaucugaguccaaaggacgaucgcaaacaguacagcgggaaccuaaucuuuccggagaaggcuaaagaagagauacgagaauggacagagaaguaucccacuaucuaccaccucagaaaugcccugaugaccgagaacaggcaauucgacauucgggaaguauuucuugcacugcaucacaucgugaaguaucguggaaauuucuuguuuaacggcaauuuccagacaggcgaggucaaccucuccgaucgcuuugacgauauuaauucugccuucaucucggcuugcggggaagaggaagcaccucagauaccaucagagcuguacaacgacauucaggagcugcucuuugauaaaaauaccagaaaguuagacaaccaaaaacagcuggccacuaaacuuagccaggacaaugauaaagacuggaguacacaguucuccaaggcuuuguucggauauaaaaccaaguuuaaggugguucugcaaucuaacgaagaucuagacgauuuccagcucgacagcgaugacgccgaugacaaaaucgcguccauuucagagcagaucgaugacgacagggguaguauccuggauaauauuaagauacuuuacagccggaucacgcugaacgaaauugugcccgacggcaaaacuuugucucaguccaugaucgagaaguacaaccuccaucgagaucaccugaaagaaauaaaggaccaauuaaagcacaccgauaauugggucaaauuugacgaucuguauucacaguacgugaacgggaagcucgagagcgaccgccauaaaaagcugaguucugaugacuucuauaaaaagguacuuacauuguuugauggagagcuaaagacuagaguuaaagaauggcaggagaagggcgaauuucugccuaaacaaaggaccgguuccaauggggugauuccacaccagcuccaucagaacgagcuggaccagaucaucgaaaaucaaagcaaguacuaucccuggcuugcaacacugaacccuaaugagaaacggcagcgcgucgccaaguacaaguugucggagcucguggcuuuuaggauuccauauuacgugggaccgauggucaccaaagaucagucugacuucgccuggaugguuagaaaguccgacgaaaaagagaucacgcccuggaacuuugaucaggugguagaccgugauaagucagcagaagaguucauuaaucggaugacuacaaaagacaccuaccugauaggcgaggauguguuaccugcuaagagucugcuauaugaaaaauuuacuguccucaacgagcugaauaacauccgaauuaauggcaagccacuuacaaccgacgaaaagcaccaaguguacagagauuuguuccagaacgccaaaagcaucuccacgaagaaauuucacaauuaucugguuuguaagcucaacaaacccaaccaucugaauaucaccggguucucugaccuuacaaaguucaacagcucacuggauaguuacauugacuugaagaaaauauuugcggaucagaucgacgaucagucccuccaagacgacuucgagaagaugauuagguggagcacuguguuugaagauaaacagaucuucgagcgcaagcugucugagauuaauugguuaaccgaccaggaacggucagaggucgccaaacugagauauaggggauggggucgccuaaguaagcgacuccuggcaggcauccacgaugaaaacgggcagcggauaaucgacgcucuuuggaauagcccuaagaacuuuaugcaaauucaggccgagguggcuuucaauaaacagaucaacgauuugaauacaaaggaacuguccgacaacaauguagaggauguucucgccgacgcauacacuucuccacaaaacaaaaaggccauucgucaggugcuguuagucguggaggauauccagaaagcuaugcauggagacgcgcccaccucgauaagccuggaauuugcaagagaggaacaggaguccucaaggacacgcagucggagagccgcucuuucugccaccuauaggcaaauuagcgaugaaaucgucuccgcaacugugaagggcgaguuggguaaggccacgucaauuagcgaccgacucuaccuguacuucacacagggaggccgcgacauguauaccggagagccgaucaauauagaugaaaucucucggggcuacgagauugaccacauccuaccucaguccuuuauuaaagaugacagucuggauaacagaguucucgugaagggggcuaucaauaacggaaaaagcgccaacuauguaauggaccagucuugggcacccgauaggcuggcgugguggaagaaacuuuuggacaaucgucugauaucccgcaagaaauaccaaucauuaacucucaccccagguaagauuaacaaguauagucagaauggcuucaucaaccggcagcuggucgaaacaagacaggugaucaaacuuguugcuaauauucugaacgaucaauacagcaaugacgauaccaagaucauuguggucaaagccgcauugaacucgcagcucaggggguuucuggagcuauucaagaaucgaaacauaaaugacuaucaucacggaauggaugccuaccuguccacuuuuaucggcaacuaccucuauaaaaaguacccuaagcugcggucuuauuucguguacggugaguucaaaaaguuuagcgggaaacagaaucuuaagucauucaacuuuuugcacgaccuggaagacgauaguauuaauaucauuuccaacgacgauggcgagaucguaggaaaccaucacgaaaugauagaggaauuagagaaggcuuaucaauacaaguauaugcucgugucucgcgagguuuucgaaaagacaggcgaccuguuuaaugucacgguguacagcagaaaagccaagaaaacccuuauccccauuaagcaggauaaaccaaucaacauuuacgggggauauuccgguaauaacgacgcauacauggcuaucgugaagcugcccggcaagaaagggaagccugauacuuauaaaauagucgggauuccacuaagguucgccggcgagcucgaacgggcgaagcagcugggugagucagccuaccgagaaaaauugagcgcuguuaucacaccgcaguuuaccaaggagaagaaagacagaaagacaggggagaucacuaaagugguggaugacuucgaaguaguccuggaucgcgugcccuauaggcaauuauuuaaggacagugauaaaugguucaugcucggcucugcagccuaccaguauaaugcuaagcagcugguucuuaacaaugacgacgugaaacuguugaacgagcagggacguaagaagcucgaacugccuaaugagaaacuauccagcgcccugaacgaugucuuugaccauauuauacaaaucaugaacucgaaguucggccuuuacgauaaaaauggguuccggaccaagcucacggaagcagcgucaauuuucuacgaccugccauugagagccgaguauaauggaaacaaaaaggugaccgauggcaagcuggagguuuuagacaauauccucauuggucugcacgcugaucccucuuucgggaaccuuaaacagcugaauaugaguacaccuuuuggacagaugcagacuaagggcggugugguauugaacggcaacuccacccucaucuaccaaagcccaacagggcuguucgaaaggcgcgucaaacuaaaggaccugucuaaauga

SEQ ID NO: 3033 - RNA, 4059 nt, Artificial Sequence
  Cas9 variant
augaagaaaauccugggccucgaccuugggaccacaagcauuggaugggccuucauaaacgagggugaaaaugauaacgagacuuccucuaucauuaaugcuggcgugagaaucgucccccugacgaccgacgaagaggcagauuuuaagaaagggaacacaauuucaaucaaugccgacaggacuuugaagcggggagcgcgccgaggcuuacagcguuucaaacaaagaagggaugcucugcuacagaguuuucgggguauaaacuucaucagcuccaauuacguuuaugccgaaaccgggaagcagacaaccuuuucuucguacaagcuccgcgcaaaaucagccacugagcuggugacaaaggaggaacuuguacaggugcuguugaugcucaacaaaaagagaggauauaaaagcaguaggaaggcuaagaccgcagaggaaggcgacgccauugauggcaugaaaaucgcuaaggagauuuucgagaauaaccugacgccugggcaaugggucuacaauucccugucuaucggagguaaauuuauaccagacuucuaucggagcgaucuccagaaggaaguggagaaaauuguucgcuuucagaaccaguuccacccggaacaaaugaaugagaaguuacuggaaaacauccagggcaaagcccgaacugugaccucccaguacuuuucaaggauucuuaauauccccuuggcggagaacaaggggacaagagaggaaacuaagcugcagcauuauaaauggcggaacgaggcacuaaccgaggaacucgaccugaagguccuugccuucaucauuacagaaauaaauaaccaaaucaaucagaguaacggauaccugggcgcuauuagcgaucguucuaaagaguuguacuuuaaucaggagaccgugggucaauuccaguauaaccagcucaaggaaaaugcccacacgaaacugaagaaccagguauucuaccgccaagacuauuuagaugaguuugaaaagaucugggagacucaguccaaauucuacccugaacugaaugacgagcucaagucagagguuagagacauaacaaucuuuuaucagaggaaacuuaagagccagaaacaucuggugaguuucugcgaauuugagaaggggcacaaggcaauuccaaaaucuucccccuuguuccaagaauuucggaucuggcagaacauuaauaacaucgucgugaagaaugagaccacuaaagagccuuuccuacugggagaagaucucaagaaagugauugcucaggagcugagcuuuaaggaaucgaugacagacucucagcuucugaccuucugugauuugaagaaaggcacgcauaccgucaacuuuaagaaaauagagggcaaucgaacaaacacuucccucuucaaggccuuugagaaaauccugguuuuagaaggguacgacgagcuggaucuaucaaagcucgacgcgagugauauuaaaagcaucaucaaguccgccuucucugaccuggaaauuagcaccgcaauacuugauuucgacccaacaauccaaggaaacgauuaugacaagcagucauacuaccaguuguggcaucugcucuauaguuccgaggaagacgauuuucugaaaaagagccuuauggacaaauucgguuuuaaggagucucaucugcccuucuugcucaauauuaaccugcaggcugauuacggcucauuaagugccaaagcuaucaagaaggugcugccucaccuaauggacgggcacauuuaugauaaagccugcacucucguaggauacaaucacagcuccucucugaccacagaccaaaacaaugaacgcgugcuuaaggauaccuuggagcugcucaaaaagaacucgcugagaaauccagucguggagaaaaucuuaaaccagaugauaaauguuaucaacgcaauuaucaaggacccggccaugggcaagcccgaugaaauuaggguggagcuggcucgggaacuuaaaaauaacaaugagcagcgcagcgaaaugacuaaggcgaucaacaaauccacgacagagcacgagcaaauaagaaaguugcuccacaccgaauuugguauucauagggucacucguaaugacaucauucgguauaaacuguggaaggagugugaugggaucucacuauacaccggcaagccuauagaaccaaguaaacuguucacaaaggacuaugauaucgagcacauuauccccaaaucucgacucuuugacgacagcuucuccaacaagaccauuugcgagagacagcugaacaucgauaaaucaaauaagacugcauacagcuuuuuccaggaaaaacuuucugccgaggaauuugaccaguucgagaagagggugaaguccuuguuuggaaaaauaagucgcacaaagcaaaacaaacuguuaauggcuaauaacgaaauuccugagggcuucaucgaucggcagcucagagagacgcaguacaucgccaagaaagcaaaggaaauucugcuugagguaagcaggaauguuaccgccacuaucgggucugugacagacaagcugcgcgaugacugggaauuggucgaugugaugaaagagcucaacugggaaaaguaugacaaacugggacuaaccuacauugaggaggguaagaauggcgaacgacuguauaaaauaaaggauuggacaaagcggaacgaccaucgucaccaugcuauggaugccaucacugucgcauucaccaaaccagcguacauucaguaucucaauaaccugaaugcuagaacgaacaccgacaagaaaggaaauuccaucauugggaucgagaacaaguaccuuaaaagggauaagaauaacaaguugcgcuuuauagaacccaucccgaacuuccgggagguggccaaaaagcaacuggaaucaauuuuaaucaguuauaaagcaaagaauaaaguugugacaaagaacaagaauguaacuaaaaagagcaacggcaccaaucagaaaauucagcucacaccuagaggucagcugcacaaggagacugucuacgggaaacuucaacaguacgugaccaaggaggagaaaaucaacgccaauuuuacgcccgaauauguuacaaagguggcuaagaaagaauacagggaggcccugcuaaagcgacucauagagaacgaaaaugacccuaaaaaggcauucaccggcaaaaacgcucugucgaagaauccaauuuauaucuccuuggagaacaauauccugguccccgaaaaggugaaaauuguaugguuaaagucugacuacacuauacgcaaagauaucacaccagaccucaagauugauaaagugaucgacauuggacugaagaccauccuucagaaccggcugaaugaguuuaacggcgauacuaagaaagccuucguuaauuuggacgaaaaccccauauggcaaaacaaggagaaagggaucgcgauuaagagagucaccaucagcggagugucaaaugcccaggcucuccacacgaaaaaggaucaucuggguaacgagauucuagacgaaaauggccagccucugccaguggauuuugucaguacagggaacaaucaccauguugcaaucuauagggacgagaagggaaaccuucaggaagaggugguguccuucuuugaagccguaacccguaauaaccucggccugucuauaauuaauaaaaaccacgagaaggguugggaguucuuguuuagcaugaaacaaaaugaguucuucaucuuuccgacugauggguucaacccccacgaaaucgaccuguuaaauacagaaaacuaccaucucauuucccgcaauauguuucggguccagaagaucgcuaccaaaaacuauauguucaaccaccaucuggagacaaagucaguggacggcgaaaugcuuaaaacuaagaagcagcugagcaaaauaaguuaccacuuuauucagaccccuucuuacuugaauuauaucauuaagaucagaauaaaccaucucggacaaauuguucagcugggcgaguacuga

SEQ ID NO: 3034 - RNA, 4059 nt, Artificial Sequence
  Cas9 variant
augaagcaggacuacuauaucggccuggauauggggaccgagagcgugggaugggccgucacagacguugauuacaaccucauuaaaaagagaggucaagacuauuggggcguguaccuuuucgaugaagcucagacugcacaggggaggcgggccuuucgcacgaaucgacguagacuggcgaggguacggcaccgcuugaacuuacugcaggagcuauucgacuccgaaauaucugcuaaagauuuuggauucuuuuauagacucgaaaauucaaaguacuucgacgaagauaaacccgagaucgccaggggcaaguuucugcuuuucaacgacaaggauuuuggugacaaagaguauuacaagaauuacccuaccauuuuccaucugcggaacgcauugcgcacacaagaaaucaaagaugugcgacuccuguaucuggccguccaccauauucucaagaauagagggcacuuuuuauucggagagcaggacuuuaacgugaaugacgcuagugauguuagcggcgaguucgagaaaaucaacagguuccuguccgagaaugacggcgcaggguuugaucgggaaaagauaccagagaucuucgaaacucuuugcaacgagaauuuggccaagcgugaacgcaaagagaagauucuggagcuagcuggaaacucuaaaaauaagcuccugggugaagccgugaacgcggucgugggccuuaacuuuucgcugucaaaaauguucggggaggacagagauuuucagggagaaaauaagaugagcuucaccgacaguuccuuugaggaaaaauuggcaaaggccaggauggcucucgaugacgaugaggccgacuuccuggagacauuaaagaaaguacagucuguugcaagccugcauaacauccuccacggcaaggaauuuauuuccgaggcuaaaaccgaagccuacgagacucaccggcgagaucuuucagaacugaagaaauaugugcgcgagaauuguccggagaaguacgcguuggucuucagaaggcaagugaagaaagguaagaaaaacacaaguggggccgacgaaaaugagaaggacgauaaaaaggugaacaauuaugcagcuuacaucggaauggacaagggcaaaggcuuugaaaagugcaaaaaggaggauuucuaugccuuucugaaaaaggagauagggauuaacgacgaaagccuacucgcuaagaucgaugagggaauuuuccugcccaaacagaucucugccgaaaauugugacaucccuuaccagguccaucuugcagagcugaaggccauuuuggcuaacgcggaaaauuacuucccauuucucaaacagaaggaugagaacugcgagaugaccguuuccgagaaaauaaucucacugaugaaguuccgggugcccuauuacguagguccuuuuacggacaaagaaacucgcuucagcuggaugauuaagaaggaaggcuuaaguacccagaaaaucacaccauggaauuuugaugacguggucgauagagacgcaucugagaagaaauucauagaaaggaugacuaacuuuuguaccuaucugacaggggagaaggugcuacccgccuccagcuuccucuacucggaguaugcuuuucugaaugaacuuaacaacuugaaaguuaauggaaccaaggaucugcgugugaagaacauucucuucgacuuugccaaaacgaauaagaaacugacucuuaagaaaugcugugagcaacuggucaagaacggcuugcucccugaagguucuaaggcacgggacguguucuccgggacagauggcgacuuuaaaaauucacugaguagcuacaucgauuucaagcgaaucauuggagacaaagccgauuuauauagagacaugugcgagaagaucauucuguggauaaccguaaucuccgauaaagaaaggcuaguuaagauuaucaaggacaaauacggcacugugcucucugaugaggagaucaaggggcugaaagcucuuaacuacacaaaguggggacgcuugagcgaaaaacugcucgacgguauuuucgagaccgauucagaaggcgaggucgggaaugugaguauaaucgagaagaugcggacggacaccgaaaacuuuauggagcuguuauccaauaaacacaacuauaagagagccauugaacuggcaaauagcgagucuaucgucgaugaaagggugacauaccgcgcgguugaggagcuuuauuguucaccagcugugaagcgaaguauuuggagcgccuugaaaaucguacgggaaauagucaaggugcagggacauuccccgaaaaagaucuucguugagacuacccgugaaaaacccgacgugacaagaaagggccaaaggacugucucucgcaagcagcagcuccuggacaaauaccgggagaaccuaagaaaugaaaccgagcugauuaagaaaaucgaggaaacagaggauucgaaguuuaacagcgacaaacucuucuuuuauuucacccagauggguaaggaugcauacacuggggaaaagauugaguuugacgauguguucaaaacggaaaaguaugacaucgaucacauauacccuagguccaaaauuaaggacgauucacuggacaaucgaguacuugugcgccggaaaaucaaccaaaguguuaagaaggauucuuacccauugagcgccgagauuagaaacaggauggagggccuguggcgucaguuacgcgacaaaaagcucaucuccgacgaaaaauuuuaucggcugacaagaucaacuccccuuacugagaaggaaugcggagauuucauaaaugcucagcugaucgccaccagccagucugcaaaagcugccauucaauugcucaagaggaugcugccugaguccgagaucgucuacaguaaggcgggcaacgugaaugaauuuaaaaagcgacuagaguucgugaaaauucgggaacugaacgaccuccaccaugccaaggaugcuuauuucaauaucgucguugggaacguguuuaauacaaaauucaaccacaauccagcaguguuucagcgcagcaacggaaccgguaauuacgacuucgagagacuguaugauuuugacauaacuaacgccuggaagaaaggcgaugaaaauaggauucggucuguagcugagaagaacacaugucgagucgugagauucuccaagacggagaaagggcaguuuuacgacgccaccaucuaucccgcaggaaagaaugauaaacuugcgccgguuaagggcaaagccccuuugaacgacacuucaaaguacgguggguacgauaaggaaacaaccgcuuauuucaugcuggugaaaagucgcgacaagaaaaagaaagauaagacauuacucagccuggagugcgucacugugcuugccgacaagaacuuuaggaccgcagaagacaaacugaaguacugcgagaaagaacuaggccucaaggagcccgagauccugauugagaaaaucaaguugaauacgcuguucaagauuaacggaucguaugcuuggauacguggccggaccaaugauagauuaguucucuguaacgccaaucagcuguggcuugacaacggguccgcaaaagaacugaagaaaaucucuaaucauuuuagggaugugaagaaauacaacaauaaggacuugccaguacgcgaagaggaguucagcaaagaacaaaaccucgcccuguaugaucuauuuacagagaagcugggaggcaagauuuacgcuggucuuccuguccaggggcagaucaaaaaucucgaaaagggacgagacaaauucgaggcgcuggaauugaaggaucagcuguucguguuaauggagauucucaaauuuaugcaaugcaacucaaugaccaguaauaucaagcugauaggcggugccgagaacgcaggcaagaauagaaucuccaaacuuauucaggacucugaugugaagaugaucuucuguagccccaccggguauuuuugcaaagucguugacuucaagcgguuucuguga

SEQ ID NO: 3035 - RNA, 4059 nt, Artificial Sequence
  Cas9 variant
augaagaaaauccugggccucgaccuugggaccacaagcauuggaugggccuucauaaaggagcccgaaaaagauguggucgguuccgagaucguugacaugggcgugagaauuguaccucugucuucagaugaagagaacgacuuugcuaaggggaauacuaucaguauuaacgcagauaggacguugaaacggggagcccgccgaaauuuacagcguuucaagcaaagaaggaacgcgcugcuagaaaucuuuaaggagaaaaagcucauaagcaccaauuucaaauacgcugaggacggcccauccucuacauuuucgacucugaaccuucgggccaaggcagccaaagaaaagaucgagcugcaggauuuggugaagguccuccugcagauuaauaaaaagcgcgguuauaaaucaagcagaaaggcuaaaagugaagaggacgauggguccgcaaucgacucuaugggaauugccaaggagcuguacgaaaacgaucucaccccgggccaguggguguaugaggcuuuacaaaaaggcaggaagaauguucccgacuucuaccggagcgaucugcaggaagaguuuaagaaaaucgugaacuaucaguccgaguucuuuccugacauauucaaugccucauuugucgaagacuggauggggaaggcgaguacaccaaccaaacaguacuucaacaagaaaggagugcaacuugcagagaauaaggguaagcgcgaggaacgaagauugcaggaauauaaauggagggccgaggcuguaaacuuuaagauugaucugagcgaaaucgcccuaauucucucucagaucaauucccagaucucaaacagcaguggcuaccugggggcaauuucugaccgguccaaagagcuuuacuucaagaaccugacuguuggacaauauuuguaccagcagauuaaaaagaauccccacacacgucucaagggccaaguguucuaucgccaggauuaccuggacgaguuugaaagaaucuggagcguccagucgucuuucuauccucaguuaaacgaugcucugaaaagggaggugcgggacauuaccaucuuuuuccaacgacgccucaagucccagaaacaucuuauaucaaauugcgaauuugaggaucaccauaagguggucccaaaaagucaccccguuuuccaggaauuuagaauuuggcagaaccugaauaacuugcuacugaucaagaaggacaaucucaacgagaaauucgaucuggagcuugaaagcaagaucgcccuggcgaaugaguuggccuuuaaaagggaacucaacgugaaggacgcacugaaaauuuuaggucugaagccuaaugagugggaguucaacuuuacgaaaaucgaagggaaucggacuaaccaagcauucuuugaugccuucgcuaagauuauagagcuagaagacggagagccaaucgaccucggcgaucugaaggccgacgauauucuugaccaguucuccgaagcauuuuugcgcaucggcaucgauaccgagcugcuccagguaaauucugacauugagggggccgaauacgagaaacagagcuauauacaauucuggcaucugcuuuacucaagugaagaugaccagaagcugaaauugaaccucaucagaaaguuuggauucaaaccggagcacgcuaagauucuggcguccaucagcuuacaggaugaccacgcaucucugucaaguagggccauuaagaaaauccuaccccaucuccagagcggucugauauacgauaaggcuuguacauaugccggcuacaaccacuccucuucguuuacuaaagacgaaaaugagaagcgugagcuucgggcagaauuggagcugcucaaaaagaacagccugcgaaauccuguggucgaaaagaucuuaaaccaaaugauuaaugugguuaacgccauccugaaagauccagagcuugggagacccgacgaaauuaggguggagauggcucgcgaguugaaggccaaugcagaacagcggaaaaacaugaccuccaauaucgcgucagcuacaagagaccaugauaaguauagggagauacucaaaagugaguucggacugaagcgcgucaccaagaacgaccuacugcgauacaaacucuggcuggaaacggauggcauuucucuuuauacugguaagccuaucgaggccagcaaauuguuuuccaaggaauacgacauugagcacaucauaccaaaagcacggcuguucgaugacucauuuagcaauaagacaaucugcgaacgucaguuaaacauugauaaagccaaugugaccgcuuucucuuuucuccaaaacaagcuguccgccgacgaguucgaacaguaucagaguagaguaaagagccuuuacgggaaacugucuaaggcaaaaauccagaaguugcucauggcuaaugauaaaauucccgaggacuuuaucgccaggcaacugcaggagacucgcuacauauccaagaaggcgaaagaaauucuauucgagaucucacggagaguuagugugacaaccggcacgaucaccgauaagcugagggaagacuggggacucgucgagauuaugaaagaacugaacugggagaaguaugauaaacuuggcuugacauacacuaucgaggggaagcacggagaacgacugaacaagauuaaagacuggagcaagcgcaaugaccaucggcaccaugccauggaugcuuuaaccguggcacucacaaaaccggccuauauacaguaccugaacaaucuuaacgcuaagggucugaauaacaaaaagggcacugaggucuucgccaucgaacagaaguaucuaaaaagagagaaugggaagcucuguuuuauuccucccaucgaaaacauuaggucggaggcuaaaaagcaccugucccguaucuuggugucuuacaaagcgaagaauaagguugugaccauaaacaaaaauaagacaaaaagcaaggccggacugaacgagcaaaucgcuuuaaccccacgcggccagcuccauaaagaaacuguauaugguaagucauuccacuacaguacgaaauuugagaagauuggggccuccuucaauguccagaagaucaacacaguggcuaaaaaggaggaacgggaggcacugcuuaaaagacuggccgaaaauggcaacgacccuaagaaagcauuuaccggaaagaacacuuugaauaagaugcccauuuaccucgaucugggcaaaaacaucaagcuaucugagaaaguuaagaccgugguccuggaacagaauuauacaauaaggaaaaacauugacccagaucuuaagguggacaagguaaucgauguggggaucaaacgaauacucgagagccggcuggaagaguucggagguaaugccaaguuggcuuuuuccaaccuggaggaaaaucccauaugguuaaacaaagagaagggcaucucaauuaaacgcguuaagaucagcggggucaguaauguggaaucucuccacgugaagaaagaccauuucggagagccuauucuggaucaagaaggcaacgagaucccagucgacuuuguuuccaccgguaauaaccaccauguggcgauauacgaggaugaaaaugggaaccuucaggaggaaguggucagcuucuuugaggccguagugagacagaaucaaggccugccgaucauuaagaaaaaccacacuuugggauggaaguuccucuucacacugaaacagaaugaauauuuuguuuuccccucggacgacuuugugccugcagaugucgaccuaauggaugagcagaacuaccaccugaucucaccaaaccuuuucagggugcagaagauugcucggaaaaauuauguuuuuaacaaucaucucgagacgaaggccguggacaacgaucuguugaagucuaaaaaggaauuaaguaaaaucaccuaccacuucuaucaaacucccgagcaucugcgaggcauaauuaagaucagaaucaaucaccucgggaaaauuauccagauaggagaauacuga

SEQ ID NO: 3036 - RNA, 4059 nt, Artificial Sequence
  Cas9 variant
augaacaagaaauacuaucugggccucgacaucgggaccaauagcgugggaugggccgucacagaugagaacuacaaucuuuauaaguacgcugguaaaagaauguggggcauuaggcuguucgaagcagccgacacugcggcugagcggcgcaugaagcgauccaaccguagaagguugucucggaaaaagcagcgcauagauuuacugcaagaacuauuuucagaggaaaucguuaagaaagaccucacguucuuuauuagacugaaugagaguaggcuucacuucgaggauaagagcaccggggaaaaauauccccuguuuguggacaaggaguacacagauaucgacuaucauaaacaguacccuacuauguaccacuugcggaaggaacucauugagaacccagagccgcaugauauccgccugguauaucuggccugccaccauauacucaagaaucgaggacacuucuuaaucaacggcuccauuucugacgugaaaaaucugucguuugucuguggugaaaugaucaaggaguucaacucagugagcgaauacgagauuagucuuaccgauaucagagaauuggagaggauacuguccgacaaaaagacagcaaaaucuguuaaggccaaacagguggcucagcuauuugagugcacccccgcagaagauaaggagcaacagaagugugccaaagcuauuaucacuaaucucagcaagcugauugucgggcuuaaaggaaacaucuccaagauguuccaccagccucuggaagagaucucaacaaaaaguuuuaaguucaccgaagccaaguaugaggacgagauuaugccagcgauagaagagaauuaccccgacuaugcaagcgugaucgaucggauuaaaggcguauacgacuggucuguuuugguggaaauccucgauggcgaggacuaucuguccuuugccaaggucaaggcuuacgaaaaacaugggaaaaacuuacacauacugaagaaugugaugaagaaauacugcaaggaugagguguaucaggccuucuucaacggaauuaacgagaaaaaugguuacggcaacuauaucggggcaauccguaagaauggacauacguacaaaauggaccgcuguaagucagaagaggauuuuuauaagggccuccagaaaauucuuagcacuaucgucccugaccaagaagaugaggagcuguuggaaaagcuaaaagcugagguugaaaaccagacccugcucccacuggccagaaguaaggagaaugguacaauucccaaccaggugcaccuucaagaacugaugaaaauauuggacaaugcgaaggaguaccucgauuuccugaaaaaggaggacgaauaugggacuaucgccgagaagauuaucucuaucgcaaaauuuaggauuccuuacuacguaggaccauuaucccggcgacacaaggaagagggcagcaacucguggaugauacgcaaagaagagggcagaaucuauccguggaauuucggggacaagguggaugucgagcagucuaacaaagaauuuauugagaggaugaccaauaagugcacauaccugaucggagaagacgugcuacccaagaacucccuccuguauucaaaauacaugguucuuaaugaguugaacaaucugaagauucgggguaacaaaaucaguguggaacucaagcagcgcauauauaaagaucuguucuguaccauggcuaaggucacgggcaagagaauccuugaguaccugaaaauggaggacccugaaauugugcaagaggauaucagcggguuugacauugauuucaaguccgccuuggcuucuuaucucgacuuuaaaaagcagguaguuggaaacgaaaucgagaaagaucauuacaaggagauaauugaagagaucauuaaguggaaaacuaucuacgacgaugacagcaagaugaugaggcguaugauagaacgggaguauccagaaguguucgauaaagagcagaucaagaaaauuugccagcugaaguacucaggcugggguaauuuuagugaccgauucuuaaacggggucagaggcgccgacaaagagacagaagaguccuauaccaucauugaagcacuguggaagacuaauuacaaccuaaugcaacuccugagcaagcaguuuucuuucaaagaggaaaucgaucagauaaaugccgagaaggcuggagacgugggcaaaauuaacuaugagaauacagucaaggaucuuaucgugucacccaguaacaaaagggcgaucuggcagaccauucaaaucgcagaagagauuaagaagguuaugaaaugugaaccugagcgcauauucaucgaaauggccagagggggagagaaggagaaaaagcggacggugagcaggaaaacccgcuugcaggaacuguacgcugguugcaaggacgauacacgaaauuggaugaaggagauuggcgaccgggaagaacgugaguuuaacuccagaaaacucuaucuguacuacacucagauggggaaguguauguauaccggagaugaaaucgacguagaugccuuaaugaaaggcaauucuaacugggacauugaucacaucuacccacagucgaggauaaaggacgauagccuggacaauaugguccuugugcgcaaagacguuaacaauaagaagcggaacaaaaucuugucccccaagauuagagaggauaugaaagguuauuggacaaugcucugccaaaaggggcugaucucaaaaaggaaguacgaccgacuaacucgcaccacagauuucaccgacgaggagcugaguggcuuuauugaacggcagcucguggagacuagacagucuagcaaggcagucgccgagcugcuuaacagguuguauaaagauuccgaagugguauacgugaaggcuggacugguuucagacuuccgucaugauaaugacuuacucaaaagccgccgggucaacgauuaucaccaugccaaggacgcauuucugaauaucguggugggcaacgucuaccacguuagauucacgucuaauccgaggaaauggauaaaggauaaccgagacuccaauuacaguauucggcgcguguuuaacuaugacgugaaacagggggauaagaucguauggcacggaagcgagaaugguggccauucuaucgaccaaauuaagaaaauaauguccagaaacgauauccuuuacacagaauauaccuacugcgagaaggggcagcuguucaaugaaacuuuggcgaaaaagggaaacgagaaagcuauugcccucaagaagaaucuggacccugucaaauauggcgguuacaccacacccaagaccucagcauuugccuucguggaguuugaugggaaaaagaaagaaaggaagaaccacaucguugagauuccaguguaugucgugaauaucgcuaagcgggaaccugacgccguuaaaaaguaccuagaggaacgaaaaggcuacaguaacgugguaauaaagaaauaucccaucaagaagaacagccugauuaaaauggauggauaccucgcaagacugcgcggcgcuaaugagaaggacaucauucuuaaaaacgccguccaguugauccugaauaaggauuuauaugagauagugaggaaaauugaaaaguaccucgaguauaaccugcaauaccaggcggacgccaaauucgaaggguuuacuaugaaggaucuuaauaugaucuaugaggagcuguaccuaaagcucaaagaaucgaucuuccagaagcguccagcucagcaaaugaaaacacuggagaagggaaaagaagcauucauuuccaucgagaacuugggcgaaaaggccaaggugauaaaugagauuaucgcuauguuucggugugacgccacgaccgucgcaaaccugaaaguuauuaaugguucucagaacgcggggagcaugaaggugaauaaaaacacuuuaacaucaaagagucucaaacugguacaucaguccaucaccggacuuuucgagacagaagaggaacugguguga

SEQ ID NO: 3037 - RNA, 4062 nt, Artificial Sequence
  Cas9 variant
augaagaaaaaguacuaucugggccucgacaucgggaccaacagcgugggaugggccgucacagaugagaauuacaaccuuugcaaauucaaugguaagaaaauguggggcauuagacuguuugaagacgcuaagacugcagccgagaggcggacgaagcgcuccaaccgacguagaauagcgaggaccaaacagcggaucgauuuguuacaagaacugugugagaagucuauuuucgaaaaagaccccacauuuuucauccgccuaaaugagucaagucuccaccuggaggauaagagcacuggggaaaaauauccucuuuuuguugacaaggaguacaccgauauugacuaucauagagaauacccaacaguguaucaccugaggaaggaguugaucgagaacccggaaccccaugauccucggcucguauaccuggcuugcugucacauaaucaaaucccgcggacauuuccuggugaauggcucuauuucggacgccaaggaucucucauuuaucugcgagaacaugauuaauagcuucaacgcagccagugacuacaaaaucaauauacaggauaugaccgcuuuagaaacuauucugacagaccgaaagauggcaaaauccgucaaggccaaacagaucgugcagcuuuuuaaguguauuccaugcgaggacaaggaacaacagaaauguugcaaggcuaucaucaccaacuugucuaaacugauuguuggucuaaagggggauauaagcaaaaucuucaaugaguccuuugaggaaauuaagucauucaaguuugccgagacgaaauaugaagacgagauccuccccacuauggaagagauauacccugaucacgcggagauuaucgaaaagaucaaaaguauuuaugacuggagcauccuggaugagauucuugacggagaagaguaccugucuuucgcaaaggugaaagccuaugaaaagcacaagaaaaacuugcaugaucucaagauacugaucaaaaaguacugugacgaugagaccuaucaguccuucuuuaauggcaugaacgagaaaaacaaguacucaaauuacauuggcagcaucagaaagaacgggcacacauauaaagucgaaaagugcaaaaguucugaggacuucuacaaggaauuacugaaacuccuuuccagcgugaauccaggacaggaggaugagucgcuguuggaacaaaucaaguuugagacugaaaaccagacccuacugccccuccugaggacaaaagagaaugguaccauuccuaaccagguacauaugcaggaacuuauaaagauccuggacaaugcuucuaaguauuuggacuuccucaacgagaaagaugaguacggcacgacugccgacaagauuaucuccauugcaaaauuuaagaucccauauuacguugggccgcugucagaucggcacaaagaaaauggaaguaacagcuggauggugcguaaggagaauggccgcauauaucccuggaacuucgacgauaaggucgacgcugaaaaauccaauaaggaguuuauccaaagaaugacaaacaaauguaccuacuuaauuggugaagaugugcugccuaaaaauucucuacucuacagcagguauauggugcugaacgagcuuaacaauuugaagauccgggggaacaagauuucagucgagcugaagcagcagaucuacaaugaccucuucugcacuaaagcccgaguuacaggaaagaacauacugaauuaucuuaaaaaggaagauccagagcuggcggccgaagacuugaguggcuuugauguggacuucaaauccgcacucaccagcuaccuggauuuuaagaagcaaguagugggcaacgagauugaaaaagacuauuacaaggagaucauugaggaaaucauaaaauggaagacgaucuauaaugaggacucuaaaaugaugaagcgcaugauugggagagaauaccccgagaccuuaaaccaggaucagaucaaaaagauuugccaccugaaguacaauggaugggguaacuucucagagacauuucuaaauggcaucaaaggggcuaacaaggaaacuggagaguguuauaccauaauugaagcccucuggaaaacaaauuacaaccugaugcagcuuuugaguaagcaauucagcuucaaagaggaaaucgaccagaucaaugcugagaagacuggcgccauugguaagaucaccuaugagaaccuggucaaagaucucgugguuuccccugcaaacaagagggccauuuggcagacaauacagaucaccgaagagauuaaaaaggugaugaaaugcgaaccagagcggaucuuuauugaaauggcucgcgggggcgagaaggagaagaaaagaacugucucuaggaagacgcgucugcaagaauuauacacaggauguaaagacgauacccgggacuggaugaaggagaucggcgaucgagaagagagagaguucucgagcaggaaacuguaucuuuacuauacucagauggggaagugcauguacaccggagaagagauagacguggauuugcucaugacagcaaauuccaagugggacaucgaucauauuuacccccagucacgcaucaaagacgauaguuuugacaacaugguacugguucggaaggacauuaauaacaaugugaaagguaacaauaucgucccgucuagcauacagaaggaaaugaccuccuauuggaaaaugcuacugcaaaaggagcucauuucaaagaaaaaguacgaaagacugacuaggagcacagauuucacggacgaggagcuuucuggcuuuaucgaacgccaguugguggagacccgacaguccaguaaagcggucgccgcucuguuaaaccggcucuauaagaauagcgaaaucguguacguuaaagccgggcuggugucugauuuccgucacgacaacaaacuucugaaguccagaaggauuaaugauuaucaucacgcaaaggacgccuuuuugaacauaguagucggaaauuguuaccgcacuaaguucacagcuaacccucggcaguggaucaaaaagaauagagauaccaacuauucaauuaggcgaguguuugacuucgauaucaaacaaggcgacaagauuguuugguacgguaacaaaaaugagaacgggaagcauacaaucgaucagauaaagaaagccaugagucgcaaugacauccucuacacugaauauaccuacugcgagaagggcaaacuguuugacgagacgcuaaccaagaaaggaaacaagaaggcaauuccccugaaaaagaaucucgauccacugaaauauggcggguacacaagcgugaagacuucggcguucgcuuuuaucgaguucgacgauaaaaagaaggaacggaaaaaccacauugucgaaaucccuauauauguggccaauauugcaaagagagagcccgaagccguaaucaaauaccuugaggagcagaagggauaugugaacaucguugucaaaaaguacccaauuaaaaagaacuccuugcugaagaucgacgguuacuuagcuaggcuccguggcggggauucuagcauaauuacccugaaaaaugccgugcaacuugugcuggacaagaaaucauaugaaaucauucgcaaggucgagaaauaccuagaucacaauaguaaguaugaagcaaacuccaagcucgagaaauucaaugaaaacgaccugaauaucauauacaacgaguugugucugaaguuaagaaauucuauuuaucagaaacggcccguucaucagcucgagacacuggaacagggaaucgauaacuuuaggagccuugagucccugaaggacaaagcuaagaucauuaacgaauugcucgccauguuccgaugcgaugcgaagacuggcauggaccugcggcuaaucgguggggccucaaauagcggccgcaugagaauuaguaaaucuaggcugaccuccaagagccuuaaacucauaaaccaaucggugacgggacuguuugagacagaggaagaguugguguga

SEQ ID NO: 3038 - RNA, 4062 nt, Artificial Sequence
  Cas9 variant
auggagaagaacuacuaucugggccucgacauggggaccagcuccgugggaugggccgucacagaugaaaauuacaaccuuaugagaaagaaggguaaagaccuguggggcguuagguuguucaaggaggcuaaaacuucugcagaacggcgcgugaagcgaacgucacguagaagguuacagcgggagaaggcccgcaucggguaucugaaagaacuauuugcggaugagauuaauaagguagacgcuggauucuaccaaagaauggaggauaguaaauuuauaagcgacgauaagaccgugcaccagaaauucacacucuuuuccgacacuaacuauaccgaugaagacuacuauaaugauuaccccacaaucuuccaucugaggaagaaacuuauugagucugacgaugaauacgacguccggaugguguuucuggccuugcucaacauguauaaacaccgcggccauuuccugaaugcaaaccugucggacaaugguaugggggauaucaacgagcaguacgaccgacucaaggaguuaugcucagaauaucugaauguugagugggaaaacaaaccugauaaguuugaggaaauucuuaaagaguguaauugcagcaacaguuugagaaaugagaggcugcuagaaaccuucaaccucaagaaaacugacaaggagaagugugaaaugcugaaacuuaucugcggacuguccggcacauugucuaagauauuuaaagaucucgacgaugacagcgagaccaagaaaaugacgaucuccuuccggucaaguaacuacgaugaagaggccauuaauguggaggaaaucauuggcagcgagaacuuugaaaucauagcuguccugaaggagauucacgacuggucuauguuagcaaauaucaugcgugggaagaaauaucuguccguggcccgcguagaagaguacgagaagcauaaagaugaccucaagauucuuaaaaagguuaucaaggaauauucaaucgaggaauacaacaauuucuucagagugauggcugacaacaauuacagcgccuaugucaacagugugaauagcaacaaagaguccacuaggcggggagcgaagugugauaaugacaccuuuuucaaagagauuaagaaaauagugaacaagugcuacgauagcgaagagaaggaauauauccugaaagagauugaaaaggguacauuuuugccaaaacagaucauaucgucuaauggcgucauuccgaaccaaguucacaagaucgagaugaaaaagauccuacagaaugcagagaaauaccugcccuuccucacugaaaaggacgauuccgggcugucagugagugagcgcauucuucagauguuuagcuuccagaucccuuauuacauuggaccaauauccggcaagaucgguucugacgaaaaaucuaagaacucauggaguguacgaaaagagaaggggagaauuuaucccuggaacuuuaaagauaagaucgacgaaaaggaguccgccgagaaauucaucgaaaggauggugaaucacuguaccuaccugaacaaugagauggucuugccuaagaacagccuccuguacgaaaaauuuaugguguuaaaugagcugaacaaucuaaagauuaacaaugaaaacauaucuguugagcucaaacaaucacuguauaauaaccuuuucaagacaggaaagaaagugaccgcuaagggcaucaaaaguuacuuggagcggaauggccugugcgaaccaaacgaggauauuaaucucacggggaucgacggagauuuuacuaaccgccugagcaacuaugccaaguucaaagguauuuuuaauacagacgaacuuaccuacgagcaguggaacauggcagagaagaucauaaagugguccacuaucuauggcgauucuaaaaaguuccuggaagagaaaauuagaaaugaauacucggagaaguuggacagccagcagaucaaaaggauucucgggaucaaguuccgugacuggggacggcuguccgaagaguuacugaacauggagggcgcugaugucaauacaggugaaauaaaaucagugauugggcgaaugugggacgagaacuauaaucuaauggaacucaucgccaccgauaacuuuacguacaagcaaguaauuaaggagaaacagaauggccuggacaagagucuuucugaaaucgauuacgacgauuuggacgagcuguauguuagcgcgcccgugaaaagaaugauauggcagacccuccugaucauuaaggaguuagucuccgugaucggauacgaaccuacaagggucuucguggagauggccaaagauguuaacacugaaaagaagcgcaccgacucacggaaaaagaaauuucuggaucuuuauaagcaaugugagaaagacgaaagagauuucuggauuaaggagaucgacgacaagagcgaggcagaauuuaggaaaaagaaauuguaccucuauuacacacagaagggccgcugcauguauacuggggagcagauaaauccacuggaucuaaccaacgacaaucuguacgauauugaccauaucuacccgcgacacuucgugaaagaugacucuaucgaaaacaaucucguacuggucaagaaggagaaaaacgcucauaaguccgauacauuucccauugaggacgauauccggaaaaaccaguaugccuucuggaagaugcuuuacgagaaaaauuuuauuaccaaggugaaguaucaacguuugacuagaaaagagccuuucagugacgaagagaaggcuaacuuuauaaugaggcagaucguugaaacgcgccagggaacaaaagugauuaccgauauccuggaaaagagcuucgacaaaacucagauugucuacgugaaggccgguaauguaucuuuauuucggcaaaaauaugaguguaucaagugcagagaaauaaacgacuuccaccacgcaaaugaugccuaccucaacaucgugguuggcaaugucuaugacaccaaguucacauccgauccaaggaacuuuauuaaagaguaccgaaagaauccccagaaaaacgaauaccauauguauaagcuguucgacuacaaugugcagcgcggggaucggguggcuuggaccgcgucaaacggagagaguaugaaagucguuaagggcacucuuaagaaaaauacaccucuggugacguuuaugagcuaugaggaacacgguggguuguacgaccagaacaucauuucggcaaaggauaucgagaaagugaagggcaaaggauaucucccaauaaaguccucugacagcagacugaauaacaccgaaaaguacggcggguaugccaaaguaucaggagcuuacuucuuugucguggagcauacuguuaagaaugugaggauucguacaaucgaacccaugccgugcuaccuaaccaaaguccugacaacuaaggagaaaaucgaagauuauuguugcaacauucucaaguacgacaguccugugguuaaguaugagaaaauaaagauguacucccugaucaaagugaacgguuaucccauguaccuuaccggccgcacggggaaucaauugauuguaucuaacggaauccagcuggucuuaagcuaugaugaggccaaguacauuaaagaccuccugaagaucaaucaggaagaguucgaucagaaccggcuugaaaaucugggcauaaacaaauuuagaaaugagaagcuauacgacacccucaacaagaaauauacaaaugagaucuacaagaaaaggccaaacuccauggguaauaagaugauugaauggaaaaacacuuuccaaaaucugucaaucaaggaccagaccgagguguugcugcaguuaauucaacucgggcagaagcagaacagcggcgugaaucuggaaaaacuuggagcaaguaagaaaacaggcgucucucugguuuccaagaaaaucacugauaaggagagcuuugaauugauaaacaagucgauuaccgggcucuaugagaacaaaguggaccugcuacgaguauga

SEQ ID NO: 3039 - RNA, 4062 nt, Artificial Sequence
  Cas9 variant
auggccgcuuucaaguacuaucugggccucgacauggggaccaacagcgugggaugggcagucacagaucccaauuacaaccuucugaaagccaaggguaaagacuuguggggcaucagagaguuuaaugaagcguccacugcuguugagaggcggacgcaccgcauuucucgacguagaaggcagcgggaacaagugcgcauaggguuacugaaggauuauuuccaugacgccaucggagagguagauccugacuuuuuccagagacuagcaaacucaaaauaccaccucgaagauaaggacaccgaggugagguauaagaauaacgucuuuaaugaugacgauuacacagacaaagauuauuucgaccaguacccaacuauuuaccaucugcggaaggagcuuaucgaaaguaccgacaaacacgaugugcgccugguguuuuuggcccuccugaacauguucaagcaucgaggccacuuucugaauagcggucucggggagaacuccggagaaaauaacauuaauaacgcuuauuuagagcugacaaaucuuuugucugaguucacccaguacaaccugaacgaaacuaucgacggcaaaaagauagaggauauccuaucgagaagggacaugucacggacacguaaggcagaaggccucgccgagauucuggggguugauuauaaaaauaagccguacaaagaacuuauccgcggacugugcgguuugaaguuuaacgcuugugccauuuuccccgagauccaaagcgacgaggucccuaaacucgauauaugccugagugaagcguccuuugacgagaagucugaugaaauugcaaauaucuuaggcgaggacuauuucgaaauuaucauggccaugaaagauaucuacgacauugggagccuggcuggaauaaugaagggccacaacuaucucucccaggccagagugaccucauacgagaagcauaaagaggaccuuaggcuguugaagaauguaauccggaaauacuguaguaaggaagauuaugacaacuucuuuaauagcgaggcagaugguucuuacgcuuccuauguugggucauacaacagcaaaacgaagcagcgacgcgugggaaauaagagaaguucugaggagcuauauaaagccauuaagaaaauccugaagaacgucccagcggaagacgccgaugugcagaggauacucauguccauugagaaugagacuuuccugcccaaacaacuuaccgcaagcaacggcgugaucccuaaucagguccacgcuaaggaaaucaagaaaauucugucgaacgccgagcgguacuugccauuucuccgcgaaaaggacgagacaggccugucuguuuccgagaaaaucaugaaguuauucucauuucagauucccuauuacguggggccuacuaccgaaaaaucaagcaaggauggagguaauggcuggguagugagaaaggaggaagggcagguccugccauggaacauagacgagaaaaucgauaugaaggcuacauccgaagccuucauuucuaggauggugcgucggugcaccuacaucagcggagagccgguucuacccaaaucaagucucgaguaucaauccuuuugugugcugaacgaaaucaauaacauuaagauagacggcgagcgaaucagcgucgaacuuaaacaggauauuuacaaggagguguuccagaaagguaagagaguaacgaagaaacaauugugcaaguaucugcauacuagggggaucauugaagcagaggagcagguuacaggcaucgacgugaccauaaauaacgcccucacuacauacggaaaauuuaaggcuauccugggcgaugacauuucuaaagacucaguccagaagaugguggaaaauaucgucuucugguguaccguguauggggauaguaagaaauuucuuaaggaccgcauugaggaaaaauacggagagaagcugacgaaagaacagaucaagcggauaguugguuucaaguuuaaagauuggggcaacuugagcaagaauuuccucgagcuguccggggcggacgugucuaccggagagucgguaagcauuaucagagcauuauggaacaauaaccugaaucuaauggaacucauuaacuccaggcuguauaauuacaaagagcgccuugccgaauaccaaaacacaaugaugaagacuuugucagauaucgaggcugaggaccuggaugaauauuacuucagugccccugucaaacgaaugauauggcagaccauccucauuaucaaggagcuggugaagguuuuaggcugcgaaccagaccggauuuuuguggagaugacacguagacccgaugaaaggaaaaugcgcacugagucucggagaaagaaauucgaggaacuguauaagaaagucaaggacgaggauguggacuggaugaaaguaaucgcacacgccgaugaaaccgguagcauaagguccaagaagauguaccuuuauuugacacagaaagggcgauguauguacaccggcaagcacauugagcucucagaccuguuuaauaacaaccuauaugacaucgaucauguguacccucgccacuucguuaaagacgauaauaucgacaacaaucugguccucgugugcaaggagaaaaacgcucauaagagcgauauuuacccacuggaagacgagauccuugccucucagaagaauaugugguccgaauugcggagaaguggauuuauuacugaggaaaaauauaacaggcugauaggccguaauagcuucacggaugagcaaaaggcaggguuuaucgcgcgccaguuaguggaaacaucucagggaaccaaaggugucgcuaacauucuccagcaacugcuucccgaguccaagaucguuuacgccaaagcaucaaaugugagugaguuccggaacacuagagacauuccuaagagcaggcugaucaaugaauuucaccaugcccacgaugcuuauuugaacauagugguaggcaaugucuacuaugugaaguucacccagaacccgcucaauuuuaucaaaaacgacuacgaucgagacaagaccaaaaacaauuauaaccugucgaagauguucgacugggauguugagcggaauggggaaguggccuggauugcacagaaaaaggacggagaggcuggcacaaucgccacugucaagaaagugcuaggucgcaacacaccccugaugacgagauacuccuuugaggggaagggcggacucaccaaugaaacucuguacucugcgaaaaaggccaaagaggaaggcuauauuccauucaagagcucagaugagaagaugaaagacguuacaaaguacgggggauucaccagugugacaggcgcuuacuuuuuccuuguagaacacacugagaaaaagaaaaggucccggaugaucgagucugucccuuuguaucuggcacagaagauagaacaaaacccccaugaguuagaaaaauauugugaacaggugcucggucugauugauuuugacauccgagugagaaagaucaagauugggagccuuauaaaacgcaagggauacuucuuuuauaucaccggcaaaacgggucacaggcugauucuacguaaugccgucaacaugugccucaagaaagaauggguuaaguacaucuccaagcuggagaaagcuguggauaagaauaacguagagggcauuaucaccaaagaaaagaaugaguugcuguacucagaauuaauagagaaauucaagaacagcaucuuuaguaaucggccaaaccccgugggggacaagcucgaugaagccaaagagaaguucauuaaucuggacaucgagaaacagugcauuguccuuugucaaauccugcaguugucuuccgugcucggaagcgaaugcgauaugacacugcuaggcgagucggcacauugugggaagauacugauuaguaaaaagaucggagacgaagauaucuaucuuauuaaccagucuguuacuggccucuacgagaagaaaaucaaucugagaaccguguga

SEQ ID NO: 3040 - RNA, 4065 nt, Artificial Sequence
  Cas9 variant
augaagaaaauccugggccucgaccuugggaccaacagcauuggaugggccuucauaaaugaggcugaaaacgagaucgaaguguccucuauugucaauacagguguuagaaucgugccccugacuacggaugaggaaucagacuuuaagaaaggcaacaccauuaguaucaaugcagauaggacauugaagcgcggggcccggcgaggauuacagcguuucaaacaaagaagggaggcgcugcuagagacuuuuaaccggauaaaguucaucgcuaccgacuuuguauacgccgaaacaggcgcagccaccacuuucagcuccuaucagcuccgcgcuaagucugcaguggaggccgucacaaaagaagaacuggugaagguucuucugauguugaauaaaaagagagguuacaaaucgucaaggaaggcuaagaccgccgaggaaggggaugcgauugacggaaugaaaaucgcaaaggagauuuuugaaaacaaucucacgccuggccaguggguguauaacagccugaguaaaggcgggaaguucaucccagauuuuuaccacuccgaccugcagaaagagcucgaaaagauaguccgguuccaaaaucaguuucauucugagcagauuaacgauaaauuacuggccgacauccagggaaagagccgcacucaaaccucccagcacuucucaaagacacuuaauauuccguuggcugagaacaaagguacucgagaagagaccaagcugcagcauuaucaguggagaaaugaagcccuagcaaacgagcucgauaugaaaauccuggcuuuuaucauuacagaaauaaacaaucaaaucaaccagaguagcggcuaccuuggggccauuucugacagguccaaggagcuguauuucaaucaggagaccgugggacaauaccaguacaaacaguugcaggaaaacguacacgcgaagcucaagaaucaaguuuucuaucggcaggauuaccuggacgaguuugagaaaaucugggagacgcaggccaaguuccauucagaauuaaacgagaaacugaaggcagagauacgugacauuacuaucuuuuaucagcgcaaacucaagagccaaaagcaccuugugaguuucugcgaauuugagaaaggccacaaggcuauccccaaaucuuccccucuguuccaggaauuuagaauuuggcagaauuugaacaaugucguggugaagaacgagacaaccaaagaggucuucgaacuaagcgaggaacugaagcagcucaucgccgaggaacugcaauuuaaggagucgaugacugauguucagaugcuuacauucugugagcugaaaaaggguacccauacggugaauuuuaaaaagauugaagggaacaggaccaauacaucuauauacaaagcauucgagaagaucuuggaaguagagggauaugaaauugacuuuuccaaaaugaagccacucgagaucaaggagacuguggcccccaucuucgaaacccugaacauuaauacagucauauuagauuucgacccuacuauccagggcaacgauuuugacaaacagccauacuaucaacuguggcaccuacucuacucagcagaggaugacgauaagcugaaagaaacccuuaagacaaaauucggcuuuaaggagaaccauuugcccuucauucugaauaucaaccuccaggccgacuacgggagucugagcgcuaaggcgauuaaaaagauccuuccucaccugauggauggacacauauaugacaaagcaugcuugaugguggguuacaaucauuccucuagccucaccacugcccagaacaaugaccggguucugaaggauacguuagaacugcucaaaaagaacucacuacgaaauccaguggucgagaagauccugaaccaaaugauuaaugugaucaacgcuauuaugaaagacccggccaugggcaagcccgaugagauccgcguagaacuugcaagagaguugaaagccaauaacgaacagaggaagaaagcuacaagugacauaaauaccgccacuaccgagcacgagcggauucgcaagcugcuccauuccgaauuuaacaucccuagaguuacaaggaaugauauuauccguuauaagcugugguuagagaccgggggaauaagccuguacacuggcaacccaaucaaagcaucugaccuuuucucaaagaacuaugauauugaacacaucauucccaaaagucgguuguuugacgauagcuucuccaauaagacacucugugagcgacagcugaacaucgacaaaucuaauaagacggcguacucguuucuacaggaaaaacugagcgagaacgauuucgcugccuaugagaauagagugaaggaccucuuuaagaccgguaaaauaaaguccuacacuaaauacaagaaacugcuuauggcagauaacgaaauuccugagggguucaucgacaggcaauugcgcgaaacacaguauaucgccaagaaggcuaaagagauucuguuagaagucucacggaaugugaccgccacaaucggcagugucacugacaagcucagacaggauugggagcugguggacguuaugaaagagcuuaacugggaaaaguacgauaaacugggauugacccauauugaggaaggcaagaauggggagaggcucucuaagauaaaagacuggacgaagcgcaacgaucaccgacaccaugcaauggacgcuaucaccguggccuuuacaaaaccagcguauauucaguaccugaauaaccuaaaugccaagacucaaggagaaaacaaagcuaauagcaucauugguaucgagaacaagcaccuguaucgggauaagaacaauaaacuccguuucauaucccccaugaagaacuucagagaggaagcuaaaaagcagcuggagucaauccuuauuagcuacaaagccaagaauaagguagucaccaaaaacaagaauacaacuaaaaagucuggcgggaccaaccagaaaauccaguugacgccgaggggacgccugcauaaggaaacaguguauggcaaauuacaacaguacgcuaccaaggaggagaagguuaaugccuccuuuacugaagacuacauucagaaaguggcaaagaaagaguaucgggaagcgcuccugaagagacuugaggaaaacgauaaugacccuaaaaaggccuucacagguaagaacgcucugaauaaaacccccaucuacauaagucuaaaggauaacauuaucgucccagagaaagugaagacuguauggcucgagaccgacuauacaaucaggaaagauauuacgccugaccugaagauagacaaggugaucgauguugggauuaaacgaaucuugcaaaaucgccugaacgaauuuaauggcgaccccaagaaagccuucgucaacuuaggagagagcccaauuuggcucaauaaggaaaaaggcaucgcaauaaagcgggugaccaucucugggguguccaacgcucaggcccugcacacuaagaaagaucaccuuggaaacgagauucuggacaagaaugguaaccccaucccugucgauuuuauuucaacaggcaauaaccaucacguugcaaucuacagagacgaaaaagggaauuugcaggaggagguggugaguuucuaugaugccguaauaaggcguaaccucggacugagcgucauuaauaagaaccaugaaaaaggcugggaguuucuauucucgaugaagcagaaugaauuuuucaucuuuccauccgacgguuucaacccgcacgagaucgaucugcuuaaucccaacaauuaccaucucauuucuccuaacaucuuccgcgugcagaaaauaagcaccaagaauuauauguuuaaccaccaccuggaaacaaaggcuguugacggggagauguugaaaucaaagaaagagcugaguaagacuuccuaccauuucauucaaaccccaacgaacuuaaauggcaucauuaaagugcggaucaaccaccucggaaagauaguccaucugggcgaauacuga

SEQ ID NO: 3041 - RNA, 4065 nt, Artificial Sequence
  Cas9 variant
augaagaaaauccugggccucgaccuugggaccaacagcauuggaugggccuucauaaaugaggcugaaaacgagaucgaaguguccucuauugucaauacagguguuagaaucgugccccugacuacggaugaggaaucagacuuuaagaaaggcaacaccauuaguaucaaugcagauaggacauugaagcgcggggcccggcgaggauuacagcguuucaaacaaagaagggaggcgcugcuagagacuuuuaaccggauaaaguucaucgcuaccgacuuuguauacgccgaaacaggcgcagccaccacuuucagcuccuaucagcuccgcgcuaagucugcaguggaggccgucacaaaagaagaacuggugaagguucuucugauguugaauaaaaagagagguuacaaaucgucaaggaaggcuaagaccgccgaggaaggggaugcgauugacggaaugaaaaucgcaaaggagauuuuugaaaacaaucucacgccuggccaguggguguauaacagccugaguaaaggcgggaaguucaucccagauuuuuaccacuccgaccugcagaaagagcucgaaaagauaguccgguuccaaaaucaguuucauucugagcagauuaacgauaaauuacuggccgacauccagggaaagagccgcacucaaaccucccagcacuucucaaagacacuuaauauuccguuggcugagaacaaagguacucgagaagagaccaagcugcagcauuaucaguggagaaaugaagcccuagcaaacgagcucgauaugaaaauccuggcuuuuaucauuacagaaauaaacaaucaaaucaaccagaguagcggcuaccuuggggccauuucugacagguccaaggagcuguauuucaaucaggagaccgugggacaauaccaguacaaacaguugcaggaaaacguacacgcgaagcucaagaaucaaguuuucuaucggcaggauuaccuggacgaguuugagaaaaucugggagacgcaggccaaguuccauucagaauuaaacgagaaacugaaggcagagauacgugacauuacuaucuuuuaucagcgcaaacucaagagccaaaagcaccuugugaguuucugcgaauuugagaaaggccacaaggcuauccccaaaucuuccccucuguuccaggaauuuagaauuuggcagaauuugaacaaugucguggugaagaacgagacaaccaaagaggucuucgaacuaagcgaggaacugaagcagcucaucgccgaggaacugcaauuuaaggagucgaugacugauguucagaugcuuacauucugugagcugaaaaaggguacccauacggugaauuuuaaaaagauugaagggaacaggaccaauacaugcauauacaaggcuuucgagaaaaucuuggaaguagagggauaugaaauggacuuuucuaaaaugaagccacucgagauuaaggagacuguggcccccaucuucgaaacccugaacaucaauacagucauuuuagauuucgacccuuccauacagggcaacgauuuugacaaacagccauacuaucaacuguggcaccuacucuacucagcagaggaugacgauaagcugaaagaaacucuuaagaccaaauucggcuuuaaggagaaccauuugcccuuccugcucaauaucaaccugcaggccgacuacgggagucuuagcgcuaaggcgauuaaaaagauccugccucacuugauggauggacacauuuaugacaaagcaugucucaugguggguuacaaucauuccucuagccugacaaccgcccagaacaaugaccggguuuuaaaggauacucuggaacuacucaaaaagaacucacugcgaaauccaguggucgagaagauccuuaaccaaaugauaaaugugaucaacgcuauuaugaaagacccggccaugggcaagcccgaugagauccgcguagaauuggcaagagagcugaaagccaauaacgaacagaggaagaaagcuacgagugacauuaauacagccaccacugagcacgagcggauccgcaagcuccugcauuccgaauuuaacauaccuagaguuaccaggaaugauauuauccguuauaaguuauggcuggagacagggggaauuagccuuuacaccggcaacccaaucaaagguucugacuuguucucaaaggauuaugacauagaacacaucauucccaaaagucggcucuuugaugacagcuucuccaacaagacucugugcgagcgacagcuaaauaucgauaaaucuaacaagacagcauacucguuucugcaggaaaaacucagcgagaaugacuucgcggcuuaugagaacagagugaaggaucuguuuaagacggggaaaauuaaguccuacaccaaauacaagaaacuuuugauggccgacaaugaaaucccugagggcuucauagacaggcaacugcgcgaaacucaguauauugcaaagaaggccaaagagaucuuacucgaagucucacggaacgugacagcuaccaucggaagugucacagauaagcugagagaggacugggagcuuguggauguuaugaaagaacugaauugggagaaguacgacaaauugggccucacucauauugaagaggggaagaacggagaaaggcugucuaagaucaaagauuggaccaagcgcaaugaccaccgacaccaugccauggaugcaauuacgguggcuuuuaccaaaccagccuauauacaguaccuaaacaaucugaacgcgaagacacagggugagaauaaagccaacagcaucauuggcaucgagaauaagcaccucuaucgggacaagaacaacaaacugcguuucauuucccccaugaagaauuucagagaagaggcuaaaaagcaacuugaaucaaucuugauaagcuacaaagcaaagaacaagguagucacuaaaaauaagaacaccacuaaaaagucugggggaacaaaucagaaaauccagcugaccccgaggggccgcuuacauaaggagacgguguaugguaaacuccagcaauacgccacaaaggaggaaaagguuaacgcuuccuuuaccgaggauuacauucagaaaguggccaagaaagaauaucgggaggcacugcuuaagagacuggaagagaaugacaacgauccuaaaaaggcguucacugggaagaaugcccuaaacaaaacacccaucuacauuagucucaaggacaauaucauagucccagagaaagugaagaccguauggcuggaaacugauuauaccauuaggaaagacaucacaccugacuugaagaucgauaaggugauugacguuggcauaaaacgaauccugcagaaccgcuuaaaugaguuuaacggagaucccaagaaggcuuucgucaaucucggcgaaagcccaauuuggcugaacaaagagaaagggaucgccauuaagcgggugacgaucucuggaguguccaaugcacaagcccuucacaccaagaaagaccaccuggguaacgaaauauuggauaagaacggcaaucccaucccugucgacuuuauuucaacugggaacaaucaucacguugcuaucuacagagaugagaaaggaaaccuccaggaggaaguggugaguuucuaugacgcaguaauuaggcguaaucuggagcuaagcgucaucaacaagaaucaugaaaaaggcugggaguuucuguucucgaugaagcagaacgaauuuuucauauuuccauccgaugguuucaauccgcacgagauugaccuucucaaccccaauaacuaccaucugaucucuccuaauaucuuccgcgugcagaaaauuagcacaaagaacuauauguuuaaucaccacuuggagaccaaggccguugauggggaaaugcugaaaucaaagaaagaguuaaguaagacauccuaccauuucauccaaacuccaaccaaccucaacggcauaauuaaagugcggaucaaucaccugggaaagauuguccaucuuggcgaauacuga

SEQ ID NO: 3042 - RNA, 4065 nt, Artificial Sequence
  Cas9 variant
auggccgacuucgcuaaguaccagcccggcaugguggcagaugggagaaaaaucccucuggacuggacccucuauuaccuuaggaagaaagcccugacacaagcgauucggaaggaggaauuggcuuggauauuacugaacuuuaaucagaaacgcggauauuaccagcuacgaggugaggaagaggaagagaacagcacuaagcacgaggaauauuacgagcucaaggucguuuccguggaagccgcagaggagggcaaagggggaaauacgugguauaacguaacccuggaaaauggcuggaucuaccguagacagucuaagauugagcuuaacgauuggguggguaaagucaggccauucaucgugacaacugaauacgagauugacgggguuaccaucaagaaagauaagaauggagaagugaagcggucauuucgcgccccgagugagaacgacuggggccugagaaagaagaggacagagagcuugcucgaagaguccggcaaaaccgucggggcuuucauauauaaucauauccugucugaacccgcagauaagauucggggaaacuuuauccgcacuauugagcgaaaauucuacaagaaagaacuggaggccauccucagagagcaaucgaagcaccagaaggaauuaaaagacauagauacacugauugcuugcaucaaggagcuuuauccuaauaacaaaccacaucaggacucauugauuaagaaagauaugaccuaccugcuaaucacggaccucaucuuuuaucagaggccccuuaagagcaagaaaagucuuauugccgauuguccuuacgaauauuacgaguacgugauaaaggaaacuggugagaauaaacggcaauccaucaagugcauugcgaaaucuaacccauauuaccaggaguuccgucuguggcaguuuaucauaaauuugcgccucuucgacagaaacaacgacaaggaaguaaccagcgaguaucuguccucaauggaagauuacacaagguuauuuacuuaucugaaugaccggaaggauauuaaccaggagacccuccuuaaagacuucuuuaagcaaaagaagguuaaacgaggcauggagaaggaguuccccauccgcuggaauuacaucgaggauaaggaaaagaaguauccuuguaacgagacaagacacgaacuguugaccgcacuagggaaagugggaauugaccauaguuggcuggaugacaaggaacucuucuacaggcuguggcaccuucuguacagcgucgagucuaaagaagaggccgaaggcgcuuugcggaagcucguggauaaugacgauuuugugaacgccuuccugaaaaucaagccauuuaagaaagaguauggugcauacuccgaaaaggcuauuaaaaaguuacuggccgucaugcgcauggggaaucuauggaacgagguugacauaugcgagcagacgagagacaggauccagaauauuaucaaaggagauaucgacgaaaagauuaaggaucguaugggccggacuuucucacaacucagcgacuuucagggccugccggaguggcuugcguguuaugugguauacgggcagcacagugaagccacagauauacagcgauggaccaaacccgagaacuugauggcauauaucaauggauucaagcaacauucucugagaaacccuauuguggaacagugcauccucgagacucugaggacaguccacgacauuuggaaagaggcuggucauaucgaugaaauacacaucgagcuuggccgcgggaugaaguccaccgccgaccagcgggcuagaaugagcaaaucgauuaugcagaaugaaaacacgaaucugaggaucaagucuuugcucauggagcugaagaacgccaaagaguuugaaaacgugcgcccauacucccccaugcaacaggagauuuuacgaaucuaugaagagggagcacugcaggaacuaaccaaggaggaugcccaguacaaugagauaucaaaaauuagucaaauggcucagccuagcgcgaacgaacuccugaaguaccggcuuugguuggagcagaaauauuguuccccauacacaggcaagcccaucucucugagcaaacucuucacuucagcauaucagauugaacacaucauaccgcaaagucguuacuuugacgauuccuucaccaauaaaguuaucugcgaggccgaagugaaccaguuaaagagcaauaugcuggguuaugaguuuauuaaaaagcaugggggcgagaucgucagauguacaaugauuggagacgugaaacugcuugaugcuaaggaauacuauaacuucguaacugagcacuacaccaauaacaggcgcaaaaaggaaaaguugcucauggaggacaucccucaggaauuucugaaucggcaaaugaacgacucuagauacauaagcaaaaagguuauggccauucuaaguaauaucgugagggaggaggaugaacaggaggcaaaaagcaaguucgucaucgccugcuccggcgggauuacagaccgacugaaacaggauuggggacucaacgacguguggaacucuaucgucuauccccgcuucgaacggcugaauaaacuuaccaauacugagaacuuugguagaugggagaacaagaaaggcaaacagguguuccaaacgucgguuccauuggaacugcagaaagauuuuagcaagaaaaggauugaccaucgucaccaugcuauggaugccuuagugauagcaugugcguccaauaacaucauuaauuaccucaacaaugagucagcuaagagucaggaaaagcgcgaggaccugcggaaaaagcugugcgauaaaaacagaaucauuaggaagccuugggaaacauucacccaggacgcccacacugcacuggagaauguagucgugucuuuuaaaaacuauauccgaguuauaaauaaggccaccaacuacuaugagaaguacgauaaaaaugggaagaaagaaaucgcugagcaaaagggacaggacaugugggccauucggaaacccaugcacaaggaaacaguguucggccaggucaacuugcgcagaaagaucaccauuaaacucaaggaugcacuggagaaaaucccagcuauaugcgacaaggaacuaagggacuauauuaauauccugguggccaaacaguuuaacaagaaacaaauccucgcgcauuucaagagcauuaauuaccggcugaacaugaaguccguagauaaaguggacguuuggcaguuuucaaacgagaaggagcccauggucgccacucgaaaaagcguggauacaucuuucgacacgaagagaauagcuaccaucacugauacagguauucagaaaauccuuuugaauuaccugaaggcaaagaacaaugacccuaacauugccuuuaccccagaagggaucgcugagaugaauaaacacauaacagaauauaacaauggcaagcaacaucagccgaucuuaaaagugcgcgucuccgagcccaagggagccaaauaccagguuggcgaaacugggaacaagaggaguaaguucguggaggcacagaaaggaaccaaucucuauuuugcgauuuacgaggauaaggaagguaaccguagcuauaauacgaucccucugaacgaggugauugaacggcuuaaacaaggccugucuccaguacccgacgccaaugagaaguccaucccucuaaaauuccaccucucaccaaacgaucuggucuacgugcccaagaccgacgaggaaaaugagauaaagauggggcagauuuauaaauucguugauaguagcggaacaacugcuaacuuugugccgcacagagucucgaauuugaucuacaacguggacaagaaaaucgccgaaaacuucuguaaucaugagauuauccagaacgaauacggcauagguuccccucagucuaagaaucaaaaaucaauuaccggggagaugaucaaggcaguuugcuggaaacuggagguggacagguuaggcaacauucacaagaucauaaaguga

SEQ ID NO: 3043 - RNA, 4065 nt, Artificial Sequence
  Cas9 variant
augaagaaaauccugggccucgaccuugggaccacaagcauuggaugggccuucauaaaggagcccgaaaaagauguggucgguuccgagaucguugacaugggcgugagaauuguaccucugucuucagaugaagagaacgacuuugcuaaggggaauacuaucaguauuaacgcagauaggacguugaaacggggagcccgccgaaauuuacagcguuucaagcaaagaaggaacgcgcugcuagaaaccuuuaaggagaaaaaucucaucccaagcaacuuccaguacgcugaggacggcccguccucuacauuuucgacucugaaacuucgggauaaagccgcaaaggaaaagauagagcuggacgauuucgugaaggucuugcuccagaucaauaagaaacgcgguuauaagucaagcagaaaagccaugagugaagaggacgaggggaccgcuauugauuccaugggaaucgcaaaggaacuguacgagaacgaccugacacccggccaguggguguaugaagcccucaaaaauggcaggaagaacguuccugauuuuuaccggucugacuuacaagaggaguucaaaaagauugugaauuaucagagcgaauuuuacccagacauccugaacaccuccuucgucgaggauuggauggggaaggcuucaacucccacaaaacaguauuuuaauaagcgcggagugcagcuugccgaaaacaaagguaagcgagaggaaagaagguugcaagaguacaaauggcgggcggaagcaguaaauuucaagauagaccugagugagauugcccuaauccucagccagauuaacucucagaucuccaacucaagcggcuaccugggggcuaucagugaucguucuaaggagcuuuauuuuaaaaaucugaccguuggacaguacuuguaucaacaggugaagaaaaacccucacacgcgccucaagggccaggucuucuacagacaagacuaucuggaugaauuugagaaaauuugguccgugcagagcucguucuacccacaguuaaaugacgaacugaagcaggaggugagggaugucacuauauucuuucaacggcgacucaagucucagaaacaucuuaucuccaacugcgaauuugaggagcaccauaagguugugcccaaaucacacccuauuuuccaggaguuccgcaucuggcagaaucugaacaauuugacccuaauaaagaaagacaaccugaaugaaaagugugaacucgcccuggaggauaagacagcacuugcuaacgagcuggccuuuaaaaaggaauugaguguaaaagacgcgcucaaggugcuggguuuaaaaccaagcgauugggaguucaauuuuacuaagauugaagggaacagaaccaaucaugccuucuuugaggcauucgcuaaaaucaucgaacuggaggacggagagccgauugaccuaggcaaccucaaggccgaugacauccuggaucaauuuuccgaagcauuccuuaggauuggcauagacacagaguugcugcaggucaauucugauaucgaaggggccgaguaugaaaagcagagcuacauucaguucuggcaccuccuguacucaagugaggacgaucaaaaacuuaagcagaaccugauccggaaauuuggauucaagcccgagcacgcaaaaaucuuggccuccauuagccuccaggacgaucaugcuucucugucaagucgcgcgauaaagaagaucuuaccucaucugcagagcggucuaauuuaugacaaagcaugcaccuacgccggcuauaaccacuccucuucguuuacgaaggaugaaaaugagaaaagagaacucagggcugagcuggaacuuuugaagaaaaacagccugcguaauccagugguugagaagauccucaaccaaaugauuaauguggucaacgccauccugaaggaccccaauuuagggcggccugaugagauacgaguggaaauggcaagagagcugaaagccaacgcugaacagaggaagaauaugacuuccaacaucgccucagcaacacgcgaccacgagaaauaccgggagauucuuaagaaagaguucggauugaagagaguaaccaagaaugaccuccugagguauaaacuauggcuggaaacugauggcaucagucucuacacagguaagccaauugaagcgucuaaacuguuuagcaaggaguaugacaucgaacacauaauucccaaagcucgccuuuucgaugacuccuuuucaaacaagaccaucugugagcgacaguugaauauugauaaagccaacguuacggcauucagcuuucugcaaaauaaguuaucugccgacgaguucgaacaguaccagucccgggugaagagucucuacgggaaacugagcaaggcuaaaauccagaaacuucugauggccaacgauaaaauaccggaggacuuuaucgcacgucaauugcaggaaaccagauauauuucuaagaaggcuaaagagauccucuucgaaauuacaaugagggucuccgugacuaccggcacaaucacugauaagcugcgcgaggacuggggccuagucgagauaaugaaagaacugaacugggagaaguacgauaaacucggacugaccuauacaauugaagggaagcauggagagcggcuuaauaagaucaaagacuggaacaagagaaaugaucacaggcaucacgccauggacgcguugaccguggcccugacuaaaccugcuuacauccaguauuuaaacaaucucaacgcaaaggccauugguaauaaaaagggcacggaaaucuuugcuauugagcagaaguaccugaaacgagagaacgggaaacuuugcuucauacccccaaucgaaaauauucgcgccgaggcuaaaaagcaucugucaaaaauccuaguuaguuauaaggcgaagaacaaagugguaacaauuaauaagaacaaaaccaagaaaaaggccggauucaaugaacaaacugcucucaccccucggggccagcugcacaaagagacagucuacgguaagagcuuucacuacucgaccaaguucgagaaaaucggggccuccuuugacgcacagaagauaaacacuguggcuaaaaaggaagagagagaagccuugcugaaaagguuagcagagaauggcaacgaucccaagaaggccuucacaggaaagaacucucucaauaagaugccaaucuaucuggaccuuggcaaaaacauuaagcugagcgaaaaaguuaagacgguggucuuggagcagaauuacaccauccguaagaacauugaucccgaccucaaaguggauaagguaaucgacguggggauaaaacgcauucuggagucacggcuagaagaguuuggagguaaugcuaagcuggcguucaguaaccuugaagagaauccuaucuggcucaacaaagaaaagggcaucccaauuaagagaguuaaaauauccggggucucuaauguggagagccugcaugugaagaaagaucacuuuggagagaagaucuuggacgaagagggcaacgaaauuccggucgauuucguuuccacugguaauaaccaucacguggccaucuaugaggacgaagaugggaaucugcaagacgaggugguaaacuuuuacgaggcagucauuaggcgaaaucagggcgaaucaaucauaaaauaucggcacgaggaaggauggaacuucuuauacagcaucaagcagaaugaguuuuucguguuccccagucaagacuuuaacccuaacgauuucgaccuccuggauccaaagaauuaugaccuuauuucucccaaccuguaccgcgcucagaaguuuuccaagguuauguacggcaauagcgccgugagagauuaugucuucaggcaucacuuggagacagugcucaacgacguuaaagaacugaaggauguggccuacaaacagcuaaagucgcugcaguaucuuaaugggaucaaaaagguacggcucaaccaucugggacaaauuauccaggucggcgaguacuga

SEQ ID NO: 3044 - RNA, 4065 nt, Artificial Sequence
  Cas9 variant
augacccugcacuacaacgugggccucgacaucgggacaaauagcgucggauauacuauuguugaugacaacgguaagauacuucaggugaaaggcaagaauggguacggaguaagaguguucaaagagggcgccacggcugcagaaaggcggaucuuucgcaccacacaucgacgucugaagagaaggaaauggcgguugcgcuuacugcaagauuucuuugagcccuauauucuaccucaggacgaugguuucuuuaucagaaggaaggaauccaaccucguccugaaugaccgggaugaggacacugccucucuuuucaacgaucgcucagaccgagauuuuuaccaggcguauccaaccauuuaccaccugagacaggcuuugaugacagaaaagaggcaauucgacgugcgggagaucuaucucgccaugcaucacauaaucaaauaccgugggcauuuucugcugaauggaaccguuaacaauuucacuaacaauaagauugaucuccacagugacuuugaggaauuaaacgcacugcuuuugaaugugaucccggagcugaaauuccagauugaccuagaucacagcacaauguuucagaccacgcuccugaacacuaccaucucccgcucuggcagacagagggaccuugucaagucguucuacaauggcucagaugacaaacaacuggccaagcagcagaagaguguggcuacagaauugcucaaagcaauacugggguuaaaggccaaauuccauaagcuguuuaaccucgaucuucuggagacuaccgagugggaguucaguuuugacgcugaagauauugacgauaaauuggccaagcuagaaccccugaugacagagaaccagcaacagguaauggacauccuccagcggauuuucgcggcaaucacccugaauggaaucguuccugaagguaaaacgcuuuccgccucuaagguggauagcuaucaaaagcacaaacaggaccugaaguugcucaaagcuauugcccagcauuccgacaagaaaacugcaacaguccugcagaccgcuuacaacgaguauauaaauggcaucgccucaaagccauuaaagcaagaggauuuuuacaaacgacugacuaacgcggugaagaaaaguagcgacccccagguggccgauaugcuagcacucauugaccaggaaaaguuccugccuaaacagcgcacaaaggagaauggggcuaucccacaccaacuucaccaguuggaacuggagagaauaauugauaaccagaaggacuauuaccccuggcucgccgaacugaauccuaaccaggcuaggcaaaaagucgccaaguauaaacuuucugagcugguugcauuucgggugccauacuacguaggaccguugaucgagcccgaagugcagcaggccaccuccaaugcucauuucgcguggauggcacgcaaggaggccggcccuaucacgccauggaacuuugaucagaaagucgacagaaaugugucagcugaaagguucauuaagcguaugaccacaaaggauacuuaucuccuggccgaggacguuuuaccccugcacagccuacucuaccaacgguuuaucgugcugaacgaacuuaauaacguccgagugaauggucagaaauugaccaagaaacagaagcaagcaguauaucaggaucuguucaaaagacagccucauguuacaaagaaacaguuuaagaguuaccucgugcaaacuggggaguucgccgagucuuccaagauugaaggacuggcuaacgagaccagcuucaacucgggcuuaacaaccgaaaaugagcugaggaaaauauuuggcgcccagcuugacgaggcacgcuaucaggucgauuucgaacagaucauugagugggcgacuuuguuugaagacgcuaagauccuccggacgaaacuggccgagaucacauggcuaaccacugaacaaauugagaagcuggcagggauaagauacaggggauggggucgcuucucucgaaaacuccuggccggccuucgggaccagaacgggcagcagaucauugauuugcugugggacaccccaaauaacuuuauggugaucgucucccaagcugccuucucagaggcaauuacaaaggaaaaugagaaguuaaucgaucguagaggagcucaggacgugauaaccgaucucuauacuagcccccagaacaaaaaggcccugaggcaaguucuugcgaucguggccgacguacagaaagcuaugggcggugucccgccucagcgcauuuuuaucgaguucgcacgggaagaugaaaagaaucccagaaggagcguggagcgaucccgccagcuggagaaauuguaccaaacaauuucuaacgaauuucucaucaauagcgagguucggcaggaacugaaggaggccguggaccagaaggucaacuucaaagauagacuauuucuguacuuccuccaagggggcguggaccuguauucaggaaagaggauaaauauugaucagcuuagucacuacgacaucgaucauauuuugccacaguccuuuaucaaagacgacagccuggauaaccguguauuagugucucagaagcucaaucgcucaaaaagugacagcguuccucuguccgaguucgcuaacuauaaguucggccccgccaugcaggcaaaguggcuucaacugaaagaagcggggcuacucucuaagcggaaauacgauaaucugacguuggacccaaccaagcugucgaaauuugcccccuuaggauucgucaacagacagcucguggagacucgacaggugauaaagcuggcugccaaccuucuggcaagcgaagagacaaaagucguuaccaucaaggcuaauaugacacaccaggugaggaaggaauuggauuuuccuaaaaaccggaaugugaacaauuaucaccaugccuucgacgcauaccucacugccuuuguagguauuuuccuguccaagcgcuauccaaaacuaaagccguacuuuaccuacggcgauuuccaaaaagggaacaagcugcccgaccuuaagaauuuuaacuuccucuaugagcugaaaaauaaggauagaucaaucgacaguaacacgggagagauuaucugggauaaacagagggacuuggcuuacaugaauaagauauauaacuuuaaaaaggucaccgugguucacgaagugcugacaaagucuggcgcguuauacaaucagacucucuauaaagccagcgaggacaaggcauccggucgggggaccaaacaacugauucgaaagaaagauaacaugccuacagaacuuuacggcggauauacuggcucaaccagcgcuuucaugucuaucgucagacuguggaagaaggacaaaccauacuacaaggugguugggauccccacgcgcauggccgccaaauuggcuaaucaggcacagcuccuggauuaucuaacaaagaaauucaccacuaggaagcuggugaagaaaacaggagacuacaagaccacuguagagcguuuugaacuugucgugccuaaaguggguuucaaccagcucgucauugauggcgggcaaccauuuaugcugggauccgccaccuaucaguacaacgcgcgggaguuguucaucaguaaggaggcuguuaaagccuuaaauaagcagcugagcacacauguggaccucguacagguguuugaugaaauucugguccaagugaacagaugguucccccuuuaugacacgaauggcuuuagggagaaacugucucacggucgcgaucgauucaugaaguugaacgacuccuuugaagagaagucagauacccagauagacguucuaaauagaauccugauuggguuccacgcaaacgccgcucggacuaaucucaaaauccugggccuuggaacagauuuaggcuuuaugacccagcaggcagggauuaggcugacagaaaaggccauccucgugcaucaaaguccgagcggauuguucgagcgcaaagucgcgcugcgugaccucaagggccugagauga

SEQ ID NO: 3045 - RNA, 4068 nt, Artificial Sequence
  Cas9 variant
augaccuacagcaucggccuggacauugggacaggauccguggguugggccgucauaggcgaugacuauagacucaagagggcuaaagggaagaaccuuaucggaguucggcuguucgauucugcaacuacggccgcggagcgccgaggcuaccguaccacaagaaggcgguugucacgcagacacuggagguuacggcugcuaaaugacauuuuugcuagugaucucgccgaacaggacgagaacuuccugccccgccuuaaauauagcugggugaauccugaugacgaacaaaacccacagcuuaauuccgauguagcaaacggugccuuguuugggucuucggagacugacaaggcuuuccauaaaaauuacccgaccaucuaucaccuccgacaugaacugaugacagauaccgcaaagcacgaccugagagagguguaccucgccauucaucacaucgucaaguauaggggaaacuuuuuaaauacugcugauaaaauaaacgccgaaaauucauucaacguggaccuguuuaucgcggcacuugacgaauacaaugaguucuuggaaacacccauuaccagcaucaaggaugcccagcuguuuagugacaaacuaacggauauuaacgcucggaauaaguccguucguguggagaacgccaugucugagacuuacgacgauaaaagcaagaucuucaaggcaauacucaccgcucuggucggcaacacagccaauuuucagacuauuuucgaccuuuccgaucuggaaaaagacgaggcgaagaacuuuaaauucaaguuggaucucgaagacguggagaccaaacuggauguaguucgcgccaaguuaucagacgaacaaaaugcauuccuggaggcugugcucaucgccuaugacggcauuacacuuaaaaugauccugggggauuacaagaguaucagccagucuaugauugaguccuauaagucacaccagagagacuggaaauacauaaagaacaaugucagguugaacgaacagaaaaucgagccugauaagaauagcgugaaauuuuucaagcuagacccaaagaaacugauuuaucccaguaaccucgcuuaccugcaagugaucucuuccaaugaagaugagcaucggaagggacuugacuauuuuaaaaccgccauacaggaugcagacauucugcagcgaaucgaaaacgauacguucuugccucgccagagaacuaagaggaaugguguccucccauaccaacugcacuuagccgagcuggagcagaucauuaaaaagcagagcaaguacuaucccuuucuagcuaacaucuacacacaagacaauaaaaccgaaaacaagcucauuggccugcuuaaauuccggguuccuuauuacguggggccauugguagaggcggaaaaggugacuggagauggcaaaaaucauuggcugauaaagaaggagcuccaggaaaacacaccgaucacccccuuuaacuucgacgaugucguggacaaagacaagucgggugagcaguuuauuaaacgcaucacggggaccgauucuuaucugaucggagagccuacacuuccagaaaauucccuguuguaccagaaguauaacguucuccaagagcugaauaacgugagaaaugaaaggcaccagcguuuacccauuaaagucaagcaggacauauucgagcacguguuuaaaaucgauaagaacguaaaugcaaagaaaguuauggccuaccugaagcuaaacggcuacggcgacuuccagauugcugggcucucagauacucggaccggaaaauuuaauaguaaccugagcuccuauaauuacuucguggaccuuuugggucgagagaagacagaaaagaucagagaggauaggcuggaagagauuaucgaaauacaaacugucuucgaggacaagauccucguggccaagcgccugucuaacuuagauuuucugaccccucaggagaaaagcaagcugucagcaaaacauuauacaggcugggggcgguugagucagaagcuccugaccacucaguucauuaaaacggcccuauccgaagcuggagacaucauuccacaaagccacucuaucauagaucugcucuacuauacagacaagaaucugauggagauucuuaacgauaagaccuuuaaugucagaaacugguugacugaacagaacaaaggcaccgagucagguaauagucuguacgaccagaucgacgccuuagcagggcccaaggauauuaaaaggggcaucacacagguguucagcauaaucgacgauauuaagaaagcgaugggauccaacccggaaaccguuuaucucgaguuugcucgcgagacucaaacaucucgacugaccaauucgcggcuuaaccgugugcaggaaaucuacaauagcccugagcugaagacggaguucgccuacuuggcaaagaaacucgaggccgaaacuaaggaguccauucaugacgauagacuguaucuauacuaucugcaggagggcagggacauguacacagggaaagaaauccccuuugaucaaauaucaaguaacuaugacauugaucacaucaucccacaggcuuucaccaaggacgauucucucgacaaucgcguacuggucaaccgggccacaaaugcaagaaaaagcaacuccccuacuuuuaccaaugacauuaucgauaacaggaagucaugguggcagagccuugugaaacgaggauugaugucuaaggagaaguucgaacgccugacggacaaacggaagaccuuuuccgagaaucagacaaaccauuucauugcuagacaauuaguugagacuaggcagauaaucaaaaauguggccgaucucauuaagaacaacuacgacgguacccaggcggucgccauccgugcuagucugacaggcgaaaugcgccgguaucuugauuggcccaaaaauagagacaugaacgauuaccaccacgcacaugacgcccugaugauggcuacuguggggaaguacguagauaggcgaggauuuuucgacaauggcagcgugucugauggugccgggaacgcauauaaucuauacaccaaggacuggcucguugcggcccgggucggcacgcgcaacgauucccagagagugaauccauauggauucauugugggcucaaugaacaguaaagcugucaggcaacagguuaauaaggagacaggggaaaucguguggggaaacgagaaucuggacuacuugcggcacgugcugagcuauaaaaagauauuaguaacccgaagacucucggguuccucuggccgccuguacgccgaaacucuuuuuagccccaacccuaaagcaaagcugaucgcucagaaggccaauaggucagucgcauuguaugggggauucacaaaagccgagagugcuuacaccgcgcucguggaguuuaacaagaaaggcgaccguuccuacaagcugauuaaaguuccaauggccaucgcaaaucgggugaacgauaagcagauuacugucaccgcuuauaucgccucucuaaaucugagagacuucagcagggugguucuugaacaucucccgcuggguacauugauacgcgaguccgaugggucagaauuuuacgccgcuagcagugaguauaagcacaacgcaaaagaacugugggcccccaaggagauuuuacgaucuuccaaaaagcucgacaaagcgacggcugauaaccugaucgacaucuucgauuuucuuaccaaugacaagacuauuagcaacuucaaguuuuacgagaaagaucuguugcaccucaagaaugugagagacaaauucguagaagccucggaugagauaaagaucaaaguccugucagacgugauuuaugaacuacauaacgaugcaggcuggcgggacccuuuuaagcacauccaagagaaaccagccuggacaaugcuucaggugaagggaggcauuaaacugucugaaaaagcugcaaucgucuaccagagucccaccggacucuucgagacaauaacuaucguuggggaguga

SEQ ID NO: 3046 - RNA, 4071 nt, Artificial Sequence
  Cas9 variant
augaagaaauucgaggaauacuauaucggccuggacauggggaccggaagcguggguugggccgucacagauuccgcuuacaacauuauaaagagacacggcaaagcacucugggggaucaggcuuuuugagucugccaagacugcggaagaacggcgcauuuuccgaacgucacguagaaggaccgaacggcgcaaaaauagacugcauuuguuacaggagaucuuugcugaggaaauuaguaagaaggacaugggauucuaucaaaggaugaaagagagcaaguacuggcacgaagauaaaaaggacaucaacggcaauaugcccgagcugccuuaugcccuauuugcagaugacgguuucacagauaaagacuacuauaagaaguacccaacuauauuucaucuccgguacgcccuggcuaccaacacaaccgauaaaccggacauccgccuucuguauuuggcacuccaccauauuaucaagcaccgagggcacuuccuguuugagggcaaaaagcuguccgaaguuaaagaguucucuacugccauugaagcucucgugcagcaggccgaggaacaggagaucgauuuaaagucgcugacacaagaggaaguacuuacccaguuggagcauauaaugucagacgcgcagugcacgaaaagcgauaagaagacucaggugaguaaacugauugucggaaccgacaagcaaaaacagaagcaggaaaaagcaaucgccgcucuaauuacaggcuguacugugaagcucuccgacaucuuugccgaucccgagcuggacaaggaagagaucucuaaaauuugcuucagcgauaauggguacgaggaaaaggagguugaaauagaguccgugcuugcagacagauuucuguugaucgcugccgcgaaaggagucuaugauuggaccgugcuccacgacauucugggugaugccagguucuuaucagaagcaaagguaaaaacauacgagaagcaucgggacgaucugcguaagguuaaacagcuccuucgcauggacaaggagguguaugaagcugucuucggcgugagugagaaaaacgaagccaauuacagcgcuuauaucgggauggccaagaaaaacggaaagaagcaaccuauagagaaaaaguguucucaggaggauuuuuacaaauuccugaagaaacaguuggacagacuauccguggacgaaaugggccaagagauuaucgaugaacugaaggcagagauggaccucgguacccuguuuccaaaacagaugaucagggauaauggggucauucccuaccagcuucacgaaaacgagcugaaugccaucuuggacaacgcucagaaguucuauccuuuucuccuggagaaggaucaagacggauacacgccaguugagaaaauucagaagauauuccgguuucgaauccccuauuacgugggcccuuuaaauacugcgcaccaggauaaaggcgggcauucauggagcguacgcaagaaagagggaaagauuuauccauggaacuucagugaaaugaucgacgaggaagagucugcaacaaaguuuaucgagagaaugaccaauaaaugcacuuaccugauuggugaagaugugcuaccgaaggagucccuccuguaugccaaauucaacguccuuaacgaauugaauaaccugaggauagacggcgagcucaucgcucccgaacugaagcaggauauuuacaauaacguguuuaaaaaguaccaacggguuacagggaagaaagugaaggacuaucuucgcaucaauggagucauuagcaaagagcaggagcugucgggcuucgaucagaacuuuaagucuuccuugaaagccuaccacgacuucaagcagaucguggguaccgggguacucucagaaagugagcaagaagacauaguuagagauaucacgcuguucgcagacagccagaagauguuaaaacagaggauucaucguaaguauccuaugcuguccgauaaacagaucgcccaacuagcuaauaagaaauacgccggcuggggacggcucucucgaaccuuucuggagaacauugagagcgugaauaaggaaacaggcgaggucaugaacaucauaacugcacuuugggaaaccaaugagaacuugaugaaacugcucucagggaaguaugacuacacaaagcagauugaacaguggaaugcgagacaaaugaaaaagggagagaucgaguaucaggauauugaggaacuguacgugaguccagcugucaaaaggcccaucuggcagacuauaaagaucgugcgcgaaauuaccaacaucauggguggcgccccuaaacggauuuucguugagguggcaagagaaccaggggagaagggaguaaggaaggucucccgccgaaaucaguuacuggaccuuuacaaagccuguaagaaagaggcucccgaauuguaugaucggcucgccaacaaggagagcgacaacgcacugcguucugauaaacuauuucuguacuauucacaaaugggcagaugcauguacaguggugacgcuaucgaucucgacgaacuguucacaaauagguaugauauagaccacauuuacccgcagagcaaggugauggacgauuccaucgacaaccgcguucuugugaagcgggaucuuaauucuaaaaagaccgacacuuuuccugucucggaggaauauagaaaagccgggaaggcgcuguggagcacguuacucaaaaagggccugaucuccaaggagaaauacaagaggcuuacacgaaccgagcccuucggagaagaugagcuggccggcuuuauugcucgccaguugguggaaacucggcagucaaccaaagcaguagcccaucuccuggaggaggcuuacccagacgccgaaaucguguaugcaaaggcgagagccguuagugaguucaggcacaaauuugauaugauuaagguccgugaagugaacgacuuccaccaugcuaaggaugccuaccuaaauauaguggucgggaacacauauuacguuaaauuuaccaaggacgcagcuugguucgugcgcaauaacccuggacggacuuauaaucugaaaaagauguuugagaacgaaacagugaaaagagguaaugagacggccuggauccccggcgauaacgggaccauuuguacuguaaagaaauggaugaggaagaauaacguccucuucacacgacgggcauacgaggugaagggaggccuguucgaccaaaauauccuuaaaaaggguaaagggcagauuccaaucaagggcggagccgacgaacgcuugagaucuagggauaaauauggcgcuuacaacaaggcgagcggggccuacuuuaugcugguugaguccgacggaaagaaaggcgaacggaagcgaaccauagaguucgugcccgucuauuuagcaaaaucacucgaagagagcguggagcugagacgcagguacugcgaagaggaacuuggucugguuaacccugaugugcgucuaucuaagauccggaaaaaugcucucauugacguagauggguuuaagaugcaccuggucggaagaacagagaacagguugcuguuaaucggcgccacucagcucgugcuguccgaagacgaucagcaacuuauuaagaaaaucgguaaguauugucuggaccaucgcgagaauaaagaugccguguugagugagaaguacgaacucaccauggaccuguucgagaaacuauaugauauauuugucuucaagcuggaacagacgguuuacgcugugaaguugagcaaacaggcaaaggaccucaaagagguaaaggaggaauuucuggccuuggaugacgagcaaaaaugccuguuacucauggaaauucugcaccuuuuccaguguucuccacagcuggcgaacuugaccaauaucggcgggggaaaguccgcuggcucacucaaaauccugagugacauuacaaagcagcaaagcgugcuacugauaaaccagucgaucacuggguuuuaugagcaggucauugaucuuaagaccaucuga

SEQ ID NO: 3047 - RNA, 4071 nt, Artificial Sequence
  Cas9 variant
auggaggugggcaacuacuaucuggggaucgacgccggaaccgauagcgucgguugggcuguuacagacaaucaguacaacgugauuagaaagaaaggcaagucccucugggggauaaggcuuuucgauggagcaaauacugcccaagaacggcgcacguuucgagcgcugcguagaaggaacgagcggaaaaagcagcgcaucaauuuguuacaggaacuguucugcaaagagauuuguaagcuagaccccaacuuuuucaucagacucagggauucuucacuguggagugaagacaaggaggagaaacagauuuauagccuuuuuaaugauaagaacuucaaugaccggaacuaccacaauaacuauaaaaccaucuaccaucugcgcgcugauuugauaaagaauaaagaaaagcacgacgcccgacucguauaucuggcaauccaucacauuaugaagaacagaggccauuuucuguucaaugguaacaucgaguccgugacaucuuuugaaaacacuuucaaugaguuuaaaaacugccucuuagaugagcuggaaauuaaucuugaguguccuucgaucucagaguucgagaacauauugaaggacaggaccuuuaaagggacacaaaagugcaaaaagcugaaagaacuauguagcauuccaaguuccgauaagaagcucgacaauaucuucaaacugauuucuggacuuaaggccgaccugagcaucaucuucgaggaugaguccuuuaaagaaaacgagcacaauaagauuucauucgcugacaguaacuacgaagagacccgggaagucuugaauagcgagauacaggagaaaacucucaucauugauaucuuuaacucuauauacaauugggugauucuguccgacaucuuaucaggcggcgaauauaacgggggacuguaccucagcaucgcaaagguuaauacauauaacaagcacaguaaagaucuuaagauucugaaaucugugaucaagaaauacuucccgcagaaguauaccgacauuuuugccuccaauaaggagaacaacuacugcagcuauauagguauguacaaaucgggcgggaagaaauacucugucaagaaauguuccgauaagcccgaagaguucuauaagacgaucaaaaauauuaucaacaagaauacugcugaagagaucucaaacgacaaagaugugcaguacauuuugagugagauagaaaauaacagcuuucuaccucugcaaaucaauaagaacaauggaguaauuccauaucaggccaacaaaaucgagcucgaauccauucugaagaaugcggagaacuaccuucccuuccugaaagagaucgacaccgaaugcaauaagacaacuucugagaagauaaucgauuuguuugaguuccguauuccuuauuacguuggcccacucaacaccagcaaaggugaaaaugcauggaugauccgcaaggaagacgggacaauuagacccuggaacuuugagcagaaaguggacaucgauaagaccgccgcugaguucauaacgaggaugacuaaccaguguacauaucugaauaacgaaaccgucuuaccuaaauacucacugcuauacagugaguauacugugcucaaugaaauuaacaauauccggauuaacggagagaagaucuccguggaacugaagcaagacauauuuaauauccuuuucaaaaacaauaagcaggucacaugcaaaaaguugcugagccaucucaacucuaauggcuacaaccugaaaaaggaugaccuuucaggcuucgaugggaauuuuaagaguagccuguccucuuauauugacuugaaaaacuacaucuucggagauaauauugacaagccacagaucuauaaccucgccgagaaaauaauucuguggaucaccuuauacggugaugacucgaagcugcuaaaacgaguucuccaaaagaacuguagcgagcagcugaauccggaacagaucaagaaaauuacgaaacuuaaauuuaagggcugggggcgcuuguccaaagcauuccugucagagcucagaggagcugauagggaaaccggcgagacaaugacuaucauuaagggucugcggaacacccagaauaacuuaaugcaacugcuuagucagaauuauacauuuacugaagagugcgagaaaauaaacucuggguacuucaucaaucccaacgaaauuagcuacgacuccaucgugaagaauauuguagccucaccuagcaucaagcgcucuguguggcagaccauacagaucgucgaggaaauucaaaaagugaugggcuccaagccaagaaaaaucuuuguugagauggcgaggggagaggaagagaaggugcguacaaccagucggaaacagaaguugcucgaucuguauaagaacauuagcgacgaaugcgccaaaggcauguacgacgagaucuauucuaaggaugaauccgacuucaaaaauauacgacuauaccuguauuacacucagaugggguguugcauguauucaggaaagcacauugaucucagucagcugagcaacacgaauaucugggacagagaucauaucuacccccaaucgaaaacaaaggacgauucccuugacaacuugguccugguguacaagucuauuaauagcgagaaaucagaugacauaaucaguccuaccauucagaacaauaugaggacuuuuuggaaguuacucuucgaucgcaaauuuaucuccgagaagaaauaucaccggcugaccagaacaaccccacuuacugacgaagaacuggcagguuucauuaacaggcaguugguagaaacacgccagucuacgaagguuauggcuagcaucuuuaagcgaauauaccccaacaccgagaucauuuaugugaaagccaagaaugucuccgauuuccggcaccguaaagacugugaaaacggcgugaaggucagagagcucaaugacuaccaucacgcuaaagaugccuaucugaacaucgugguugggaauguguacucaagcaaguucacuaacaauccgcuaauguggcugaagaacaauaggaacguaaaauauagucucaaucgcauguacgacuuuaaccugacagucaauaacgagaauauuugggugguuggaaacgaaggcacccaaaagacagugaacaaauaccuugguaagaaugauaucuuguauacucgguacgcaaugaccaacaaaggggagcuguucgaccagaauccuuuaaaggccacgggcgauaaaucuaagcagaccacacucgucccccugaagaaaggaaaggaaguguggaaauauggcggguacaacuccauaacuccaagcuauuuuaugcuuguagagucgaaggacaaaaagggaaauuacauuagaaccaucgaaacaaugccucuguauagggagaaggaguucucaaagaacgaagaguuucuacucaauuacugcaaggaagugcauaaacugaaggagcccaaaaucauuuugaaguguaucaagaaaaacgcucuguuaauaguugaugguuucccaaugcaccucaagggcucuacugggcugcaacuuaaacugcagggagcgguccaguugauucucgagagugacauggugaucuaccugaagaaacuaaugaaguuugugaaugaaaacaauauuaacaagaauaaacuggaggucacccccuauauggaacuuuccgcaaaggagaacaucaaacucuacgauauauucauucagaagcugacgacaggcaucuauagcaaacgaccugccaauccaguugaaaaguugaucaacgcucgcgacauuuuuaucgagcugaccgugaaagagcaaugcauuguguuaucugaaauacuccaucuguuccaguguaagccgcuuacuagcgccaaccugguauccaucaauuugaagaaaacagucgguauuauccagaucgcaaagaacauuaccgccaaaaaugugaagcucguucaccagucacccacugggauauacgaguauaccguggaucugaacaaaaucuga

SEQ ID NO: 3048 - RNA, 4071 nt, Artificial Sequence
  Cas9 variant
augaccaagaaagagcagcccuacaacaucggccuggacauugggacaagcuccgugggaugggccgucacuaaugauaacuaugaccuccuuaauauaaagaaaaagaaccugugggguguuagauuguucgaagaggcucaaacggcaaaagaaaccagguuaaaucggucuacacgccgacguuacagaaggcggaagaaccgcaucaauuggcugaacgagaucuuuucagaggaacuagccaagacugauccuaguuuccucauuagacugcagaauagcuggguguccaaaaaggacccagauaggaaacgggacaaguauaaccuuuuuauugauggcccguacaccgacaaagaguauuaccgcgaguuccccacaaucuuucaucugcgaaaggaauugauacucaauaaggauaaagcggacaucagacugauuuaucuggcucuccacaacaucuuaaaguacagggggaauuucaccuacgaacaccagaaauuuaacauuucuaaucugaacaacaaucuuucgaaggaguugaucgagcugaaccagcaacuaauaaaauaugauauuucauucccugacgauugcgacuggaaucauaucagcgacauucucaucggacggggcaacgccacucagaagaguuccaauauccugaaagauuuuacacuugacaaggaaaccaagaaacuguugaaggagguaauuaaccucauacuggguaauguggcacacuuaaacacgaucuucaaaacuucucugaccaaggaugaagagaaacucaauuuuagcgggaaggacauugaauccaaacuugaugaccuggauucaaucuuggacgaugaccaguucacaguccuagaugccgcuaaccguauauacaguacuauuacccugaaugagauccucaacggagagagcuauuuuucuauggcaaaagugaaucaguacgaaaaccaugccaucgaccuguguaaacuucgcgacauguggcacacaaccaagaaugaggaagcuguugagcaauccagacaggccuaugaugacuacauuaacaagccaaaauauggcacgaaggaacuguacacuucauugaagaaauuccucaagguggcgcugcccacaaacuuagcaaaagaggccgaggaaaagaucagcaaaggcaccuaccuggucaagccuaggaauagugagaacggggugguaccauaucagcuaaauaagauugaaauggagaaaauaaucgauaaccagucucaauacuaucccuuccucaaggaaaauaaagagaagcugcuuuccauuuugagcuuucggaucccuuacuauguuggaccacugcagucggcugagaaaaacccguucgccuggauggaacgaaagucuaauggucacgcacgccccuggaacuuugacgagaucguggauagagaaaaauccucaaauaaguucauuaggcggaugacugucacagacaguuaccucgugggcgagccugugcugccaaagaacagccuuauauaucagcgcuacgagguccugaaugaauugaacaauaucagaauuaccgagaaccucaaaacgaaucccaucggguccaggcugaccguugaaacaaagcaacguauuuacaacgaguuauuuaaaaaguauaaaaaggugacuguaaagaaacugaccaaguggcuaaucgcucagggauacuauaaaaacccuauacucaucggccugucucagaaggaugaguucaauagcacacuuacuaccuacuuggacaugaaaaagauuuuugguucaaguuucauggaagauaacaagaauuaugaccagaucgaggaacugauugaguggcucacaaucuuugaagauaaacaaauacugaacgagaaguuacauuccagcaaauacucuuauaccccagaccagauuaagaaaaucucaaauaugcgguacaagggguggggacgacugaguaagaaaauucuuauggauaucacuacggaaacaaacacuccccaguugcuccagcugagcaauuacuccauacuagaccugaugugggccacuaacaauaacuucaucucuauuaugucgaaugacaaguaugauuuuaaaaacuacaucgagaaucacaaccucaauaagaacgaggaccaaaacauuagcgaucuggugaaugacauccaugucuccccggcgcuuaaaagaggcauaacccagucaauuaagaucgugcaggaaaucguuaaauucaugggccacgccccuaagcacauuuuuaucgaggugacaagggaaaccaagaaaagugagauuacuacaucucgcgaaaagcggauaaaaagauugcagagcaagcuguuaaacaaagcaaaugauuucaagccccaacucagggaguaucuggucccaaacaagaaaauccaggaggaacuuaagaaacauaagaaugaccuguccucagagcgcauuauguuguacuuccuccagaacgggaaaagccuguauucugaagagucccuaaauaucaacaagcugagugauuaccagguggaccacauucucccucgaacguauauccccgaugacagccuggagaauaaggcucuuguauuggccaaagaaaaccaacggaaggcugaugaccuguuacucaauucuaacguuauagaucguaaucuggagagauggaccuacaugcuuaacaauaacaugaucggacugaaaaaguuuaaaaaucuaacuaggcgcgugauuacagacaaggacaagcucgguuucauccaucggcagcugguccagaccucccaaauggugaaaggcgucgccaacauuuuggauaacauguacaagaaucaggggacaacuugcauccaggcaagagccaaccugucaaccgcuuuuaggaaagcguuaaguggacaggacgauacguaucacuucaagcauccagaacucgugaaaaaucgaaacguuaaugacuuucaccacgcacaagaugccuaccuggcuagcuuccuuggcaccuaucgccugcggagauuucccacaaacgagauguugcucaugaauggugaauacaacaaguucuauggccaggugaaggagcuguacucgaaaaagaaaaagcuaccugacuccaggaaaaauggguuuauaauuucuccacugguaaacggaacuacccaguaugaucguaauacaggcgagaucaucuggaacgucggguuccgcgacaagauucuuaaaauauuuaauuaccaucaguguaacgugacucggaagaccgaaaucaagacgggacaauucuacgaucagacaauuuauagcccgaaaaaucccaaguacaaaaagcucaucgcccagaaaaaggacauggauccuaacauuuaugguggcuuuucaggggacaacaagaguuccaucaccauaguuaaaaucgacaauaacaagauuaaaccaguggcaauccccauuagacugaucaaugauuugaaggacaaaaagacucugcagaacugguuagaggaaaaugucaagcacaaaaagucuauacaaauuaucaaaaacaaugugccuaucggacagauuaucuacagcaagaaaguaggccuccugucccuuaacucagauagggagguggccaaucgacagcaacugauauugccacccgaacauagcgcucuccugcggcuacugcagauuccggacgaggaucuugaccagauccucgccuucuaugauaagaacauucugguugagaucuugcaggaauuaauaacaaagaugaaaaaguucuacccuuuuuauaaaggugagcgcgaguuccugauugcaaauaucgaaaacuuuaaucaagcgaccaccagugaaaaggucaacucucucgaggagcugaucacccuucugcacgcuaauuccacaagcgcccacuugauuuucaacaacaucgaaaagaaggcauuugggagaaaaacgcauggccuaacccugaauaacacugacuucauuuaccagucggugacaggacucuacgagaccaggauacacaucgaauga

SEQ ID NO: 3049 - RNA, 4071 nt, Artificial Sequence
  Cas9 variant
augaccaagaaagagcagcccuacaacaucggccuggacauugggacaggaagcguggguugggccgucacuaaugauaacuaugaccuccuuaauauaaagaaaaagaaccuguggggcguuagauuguucgaaggggcucaaacggcaaaagagaccagguuaaaucgguccacacgccgacguuacagaaggcggaagaaccgcaucaauuggcugaacgaaaucuuuucugaggaacuagccaauacugauccuucauuccucauuagacugcagaacaguugggugagcaagaaagacccagauaggaagcgggacaaauauaaucuuuuuauugauaacccguacaccgacaaggaguauuaccgcgaguuccccacaaucuuucaucugcgaaaagaauugauaaucaauaagaacaaggcggauauuagacucguauaucuggcucugcacaauauccucaaauacaggggaaacuucaccuacgagcaccagaaguuuaacauuuccacuuuaaauucuaaccugucgaaagaacuuaucgaguugaaucagcaacugauaaaguaugacauuucauucccugauaacugcgacuggaaucauaucagcgauauucuaaucggccgggguaacgccacacagaaaaguuccaauauccucaacaauuuuacccuggacaaggagacgaaaaagcugcuuaaggaagugauuaacuugauacucgggaaugucgcacaccugaacacuaucuucaaaaccucuuuaacaaaggacgaggaaaaacugagcuuuuccggaaaggauauugagucaaaacucgacgaucuugacaguauccuggaugacgaucaguucacuguguuggacaccgccaaucguauauacagcacaauuacccuaaacgaaauccugaauggcgagucuuauuuuuccauggcuaagguuaaccaguacgagaaccaugcaaucgaucucuguaagcugcgcgacauguggcacacgacuaaaaaugaaaaggccgugggccuuucaagacaggcuuaugaugacuacauuaacaaaccaaaguaugggacaaaagagcuguacaccagcuugaagaaguuccucaaagucgcccugcccacuaauuuagcgaaggaagcagaggagaaaaucaguaagggaacauaccuggugaaaccuaggaacucugagaaugguguaguuccauaucaacuaaacaagauugagauggaaaagauaaucgacaaucagucccaguacuaucccuuccucaaagagaacaaggaaaaacugcuuagcauuuugucguuucggaucccuuacuaugugggcccacugcaaucuuccgagaagaauccguucgccuggauggaacgaaaaucaaacgggcacgcucgccccuggaauuuugaugagaucgucgacagagagaagaguagcaacaaauucauuaggcggaugaccgugacggauuccuaccucgugggagaaccuguccugccaaagaacucucuuauauaucagcgcuacgagguucugaaugaauugaauaacaucagaauuaccgagaaccucaagacaaaucccacuggcagcaggcugaccguggagacaaaacagcauaucuacaacgaauuauuuaagaauuauaaaaagauuacuguaaagaagcugaccaaguggcuaaucgcccaagguuacuauaaaaacccuauacucaucgggcugucacagaaggacgaguucaauaguacacuuaccacuuacuuggauaugaaaaagauuuuuggauccagcuucauggaaaacaauaaaaacuauaaucagaucgaggaacugauugaguggcucacgaucuuugaggacaagcagauacugaacgaaaaguuacacucuucaaauuacaguuauacaagcgaucaaauuaaaaagaucuccaacaugcguuacaaaggcuggggccggcugucuaagaaaauucuuaccugcaucacuaccgagacaaauaccccaaagucguugcagcucagcaacuacuccgugcuggaccuaauguggacuacaaauaacaacuucauaucaaucauuaguaaugauaaguaugacuuuaaaaacuacaucgaaaaucauaaccugaauaagaacgaggaucagaauauuucuaaccucgucaaugacauccacgugagccccgcacugaaacgagggauaacgcaguccauuaagaucguucaagaaaucgugaaauucaugggacacgcuccgaaguauauuuuuaucgaggucaccagagagacuaaaaagucagaaauuacaaccagcagggguaagcgcauacagcggcuucagucuaaauugcugaacaaggccaauggcuucaaaccucaguuaagaaaguaccucgugcccaacgagaaaauccaagaagaacugaagaagcauaaaaaugaucuuuccagugaaaggauuaugcuguauuucuugcagaacgggaaaagccucuacucugaggagucccugaauaucaacaaacuaucagacuaucagguagaccacauucugccacgcacauacaucccugaugacagucucgaaaauaaggcgcugguucuugccaaagagaaccagcgaaaggcagaugacuugcuguuaaacagcaaugugauagauaagaaccucgaacgguggacuuacaugcugaauaacaauaugaugggacuuaaaaaguuuaaaaaccugacccguagagucaucacggacaaggauaaacuaggcuucauucauaggcaacucgugcagaccucgcagauggucaaggguguggcuaauauccugaacuccauguauaagaaucaagggacaacuuguauucaggcccgcgcuaacuugucuaccgccuuucggaaagcacugagcgaccaggaugacagauaccacuucaagcaucccgaguuaguuaaaaauaggaacaucaaugauuuucaccacgcccaggacgcuuaucucgcgucauuccugggcacauaccgacuucgccgguuuccaacugaugagaugcuguugaugaacggagaauauaauaaguucuacggccaagugaaagagcucuauaguaagaagaaaaagcugcccgacuccaggaaaaacggguuuauaauuucuccucuaguaaacggaaccacgcaguacgacagaaauacaggugaaaucaucuggaacgucggcuuccgugauaagauucugaaaauauuuaauuaccaucagugcaacgugacccgcaagacugagaucaaaacagggcaguucuaugaccaaaccauuuacagcccaaagaauccgaaguauaaaaagcucaucgcacagaaaaaggauauggaccccaacauuuacggaggcuuuuccggugauaauaaaucaagcaucacuauaguuaagaucgacaacaauaagauuaaaccuguggccaucccaauucggcuuaucaacgaucugaaggacaaaaagaccuugcagaauuggcuggaagagaacgucaaacacaagaagaguauacagauuaucaaaaauaacgugcccaucgggcaaauuaucuauucuaagaaaguaggcuuacucucccugaauagcgauagagagauagcuaacaggcagcagcuuauucugccuccagaacauucggccuugcuccgaauccugcaaauucccgacgaggauccggaccagauccuagcauucuacgacaagaacauacugguggaaauucuucaggagcucaucacaaaaaugaagaaguucuauccuuuuuacaaaaaugaacaggaguuccuggccucaaacaucgagaauuuuaaccaagcuacgaccucugaaaagauuaauaguuuggaggaauuaaucacucugcuccacgccaacuccacaagcgcacaccugauuuucaauaacauagagaaaaaggcguuuggacggaaaacccauggccuuacacugaaugauacugacuucaucuaccagucuguuaccggguuguaugaaacgcgcauucacaucgaguga

SEQ ID NO: 3050 - RNA, 4071 nt, Artificial Sequence
  Cas9 variant
augagcaagaaagacuccgaguacuauaucggccuggauauugggaccaacucugugggaugggccgucacaaaugguaaguacgaccuccuuaacauaaagaagaaaaaucuguggggcguuagauuguucgaagcugcagagucagccgcggggaggcggaucaaccgcaguacucgacguagauauaggcggcgcagaaauaggauuaacugguuaaaugaaaucuuugcugaugagcugagcaagguggaccccuccuuccuaacgcggcucaacucuucguggauuucaaagaaagauagcagucgcacccgagacaaguacaaucuguuuauggaugccgacuauacagauaaaaacuaccaccauaaguauccuacuaucuaccaccuuagaagggaccugauguucgaugacaaacaguuugauauacgguugguauaccucgcacugcauaauaucauuaaguaucguggaaacuucaccuacgaccaccgcaaguuuaauguguccgaaaugucuagcaaccugacaaaagcccucgagaauuucaaccaagaguuaauggaauuugaggacgcuuucccagauaacaccgacuauuccgcaaucucagaaguccugcuuaagaguaauaacgugagcacuaaaauugaugagaucauaucuaauuuggagcuggacaaggauaccaaaaaguaccuaaaagaaguucucaagcugauucuuggcaacuccgccaaucugaacacaaucuuucauacgucauuggacaaggaugacgagaaacucagccugagugcuaaggauauugaauuaaaacugaauaaccucgacucucuucuguccgaugagcagauccacuucaucagcucggccaaugaauuguauucuuccauuacucuaaacgacauacuggacgguaagaccuaccucucacuggcgaaaaucaagcaguaugauacacacugcagugaccuucaggagcugaaggagaugugguacaaaacuaccaauccggauuugauuaagaaaagcagaaaggcauacaaagaauaugugcauggguccuacaacacagaggacuuuuauaaggccaucucucccuuccucaagauagcuauuccugaagaucuggccaaagacgcauuaaagaaaaucgaugcuaauaccuaccugccaaagcaaaggacgagcaacaauggagucauccccuuccagcuaaaccucauugagcuggagaaaaucauugacaaccagucaaaguauuacccuuuucuuaaggaaaaucgggagaaaauaaucaguauuuuguccuuccgaaucccauauuacgugggccccauccaggccccuacugauaagaacuuuagcuggaugguuaaaaagauucaagcgaaagcccgcccauggaauuucgacgaaguaauagauagagagaagucuucaaacaauuuuaucaaaaggaugacaaccacugacacauaccuggugggcgaaccgguccuccccaagaacagucugauuuaucagaaguucgaggugcuuaaugaacugaacaauauccggauuagcaaaaacuugucccaggauccucucgggucuaagcugucgguggaggucaaacagcaaaucuuugaggaauuauucaagcgcuacaaaaccguuaagagcgaccagcugaagaaauggcuaauaagaaauuccuauuuuacggacccaaccaucauuggacucucaaagcccagugaguucaacucuagccuguccacauuuaucgauaugaaagcaauuuucgguauggacuuugugaauaacccuagaaauucaagccagcuugaagaguuggcugaguggcugacuguauucgaagauaagcaaauccucucugagaaaauacgucacuccaacuacccauauagugaccagcagauucggaagaucagcaacaugcgauacagaggcugggggaggauuucuaagaaacuguuaugugauaucaagguggaauccaccauauauaaaucacaucagcugcaccccuacaguauccuugacuugauguggagcacaaauaacaauuucuacucgauucuccacaaggauaaauauaacuuugaguccauccuggaagacuacaaucuaggaacugaugacaagaccgauauuaacgagcuggucgacaauauccauacaucuccggcccucaagcgcggcauaauucaaagcaucaacaucgugaaagagcugguuaaguucaugggucacgcuccucagcauauuuuucuugaguucacccgggaagauaaaacuucaacguugagugaauccagaaagaaaaggcugaagaaauuauauaauaaccucucugaggacacaaagaaguuuaaacuggaccuucgcgauuaccuggugcccgacaagagcauccagaaagaauuggagucccacgauaaggaccucucaaaagagcgacugaugcuauauuuccugcagaaugggaaaagccucuacagugaugaagcccuggacauuaaccggcuuucugaguaucaagucgaucauauauugccacguaccuacaucaaggacgauucccuggaaaauaaagcauuagugcucgccaaggagaaccagagaaaagcugacgaucugcuucugcagccuagcauuaucaauaagaacauggaaagguggauuuacaugaaagaccacggaaugaucucgcccaagaaguuuaaaaaccuaacucgcaccacaauaaccgaggacgauaagguacacuucaucaaucggcagcucguucaaacuucacagauuaucaaaaacguggcgaauauucuggacaacauguauaaggagcagggcacaacgugcgucgaaaccaaagcaaauuugucuagugccuuuagaacugcuuucuccgagcaggaugacaaguaccauuuuaagcacccagaguucaucaaaaacagggaugugaaugacuuucaucacgcccaagaugcauaucuggccuguuuacucggccuguaccgaauacagcgcuuccccagcgacgaaaugcuucugauuaagaaagaguaucggaaguucuuugcucaggcccaaaacucugucaaaaaucacgggaagaucccugauagccagaagaacggauucaucuuggcaccacucgugaauggugaaacacugauuaacaauaaaaccauggagacaauauggaacauggacuacaagagaaaaguuaucaagauuuuuaauuauaaacaguacaacaucacuaagaggaccgaaauuaaaacgggcgaguucuacaagcagacccuauauuccccgcaugaugaaaaugugaagaaccccaucccucagaaaaagaaccuggacccaaaaauauacgggggauauucaggcguacaaaguagcuaccuugcgaucauuaaggucgaucagaaaaagcccacaauggugucuguuccuauccguuuuuccaagaugauugacgacgguaaacucucacugcagaguugguuggagaauaacaucaagcacaaaaagacuauagaggugcugaaaaccaagauuccaaucgggcaauuaacauauaaucccaagaacggcuaccucagcguccaguccgaaaaagagaucgcuaaugcccagcagcuguuccuuccguuugaacauguggcacuguugacucuccugcacgccccuaccucugaguaugaucaaauucuaucguucuacgacacggauauccugcuugaaauauuugacgagauuacaaacaagaucaaaaccuucuuuccauucuacauugaugagcaggaauaucucguaagcauccgcgagaauuuccagucagcuacugugauagaaaagguuaacguccugcaacaguuguuaauuaugcugcaugccaauuccagucggaucucuaucaaacucggagaggugagcaagaaggaccugggcaggaaaaagaaaaggauuccccuugaaaacacagaucugguguaccaguccgucaccggguuguaucagacuaaguuucacaucgacuga

SEQ ID NO: 3051 - RNA, 4074 nt, Artificial Sequence
  Cas9 variant
augaacgacagaaauaagaaauacaacaucggccuggauauugggaccggaagcguggguugggccgucacagacaauaacuauaaucuccuucacgcuaagaaaaagaaccuguggggcauaagguuguucgauggggcagagacugccgcgucccggcgcacguuucgaucuacccguagaagguaccggcgcagaaggaaucggaucaacugguuaaaugaaauuuucgcugacgagcuggccaaaaaggaucagucauuucuaguucgcaugaacaguagcuggguguccaagaaagacaagauccgacaaagagaucaguauaaucucuucauggacucugauuacacagacguagaauaucauagggaguuucccacuauuuuccaucugcggaaacgucuuaucgaagauaagucgcaggcagacauacgccugguguacuuggcccuccacaacaucauuaaauauagaggaaauuuuaccuacgagcaccagaacuucgaugucucacauauggacagcggccuggcucugcucuuaaaucaacugaaccagcagcuucaggcauuugagguggccuucccugacgaaacaaacuuugagaguauguccaccaucuugcuggaaaagaagacuccaacacagaaaauugaugagaucguugaccaaauacagccggagaaggaucuacuccagauuaccaaaaauaucaugaagaugcugcuugguaacaaagcugaccuggugaagauuuucucuuuggauagcgacgauaaaaucacggucgaauuuuccucaaauaguaucgagcaagaccucagcaaccuggaagagacuuuaucugaugaacaguucaauauuauaacccuggccaacuccaucuacucaagcauugugcucaaugacauccuuaguggggagacauaucugucuuucgcgaaggcaaggcaguacuccgaucacaagaaagacuuggccaagcuaaaaacuauguggcgggagagccccgaccgaaaggcuguaggaaaagccaagaaggcauaugaugacuaccugcacucgggcaaauauggcauagaagauuuuuacaaggacaugucuaaauuccucgagaccgcuacaccuguugaacuggccaaggaggcgaacgagaaaauucuuaauaaguccuaucuguugaagcaacgcaacaaugaaaacggggugaucccauuucagcucaauaaaaacgagaugaucgaaauuaucaauaaccaggccaaguacuaccccuuccuggcagagaacaaagauaaguuacugucaauucuaaguuuuagaauaccuuauuacgucggaccacuccagagcaaaaaggacaaucccuucgcuuggauggaaaagaaaucccaagguaagaucaggccuuggaacuuugaugagauuguggaccgggaagccucuagcaauaacuucauccgcagaaugaccucaacggauacuuaucugaucggcgagccagugcuuccguugaaaagucccauuuaccagaaguaugagguccugaaugaacucuccaacguuaggauaaaugcugacgagguggauaacccucugggggacaaacuuagcguagaucugaagcaggccaucuacaaugaauuguuucucaaacaucguucugugucaaaggcacuguuaacaaaguggcugauuaaccagaguuauuuccaaaauccacagaucagcggacuagccgacuccaaaaaguuuaacucuggccucaccacuuaccacgacuucaaaaagauuuuuggugaggauuucgucaaugaccccacaaaccagucgcagcuggagcaacuugcugaaugguugaccaucuucgaggauaaaaagauacugaagaucaaacucgacgauagccaguuuaauugcacgccugaacagauuaagaaaaucgcggggaugcgguaccagggauggggccgacuguccaagaaauuacugugugacauuaagaccacaacugugaccucaaagaaccaucaacaggcaaguuauucuauccuugauuugauguggaacacaaauagaaacuucauaagcguucucaaaaaugacacuuacaaguuugaggauaaaauucagaccuucaaccuggacaagaaugaagccgcuacaccacaagccaugaucgaugagcuacagaccucccccgcacugaaaaggggcauucgccagucagugacuaucauacaggagcucgucaaguuuauggggcacgccccggaacacaucuuccuggaguuuacgcgggaagacgaugugagcucucuuacaaaguccagagacaguagguugaacaaacuguaugcucgcauugccaagaauaccaaaaagacugacgaugagcucaaaaagagcuuacugccuucuuccgacaucaaagcaacccuuaaggcgaacaagaauaaccugucaaaugaucgauugaugcucuacuaucugcaaaugggaaaaagucuauacagcaaccagccccuggacauuaaucggcucucggaauaucagaucgaucauauacugccacaguccuacauuaaggacaacucucuugagaaucgugcuuugguacuggccagcgagaaccaacacaaaucaagugauuuacuccugaagccugaaaucaucaaccagaauauugcaagauggagguacaugaaagacgccggucuuaugggccccaagaaguucaaaaaccugacacgcauccagauuaccgauuccgaccagaauaacuuuauaaaucggcagcuaguucaaacuucucagaucauuaagcaugugagcaacauccucgauuccauguauggggaccaaggaacacagugcgucgagacgagagcucaccugucaaccgaguucaggaaagccuuuagcaaugaagacgauaacuaccauuuccagcacccagaauuugugaagaaucgaaacauuaaugacuaucaccaugcacaggaugcuuacuuggccugucuguuaggccucuaucaaaugaaaaaguaccccacugacaacaugauccugcuuaagaaagaguauaagcgcuucuucaguaauaccaaaaagauauacgauaaaaagcaccauuuuccugacuacgucaagaacgguuggaucauugggucuauguucaauggcgagaaauauguggaugaagagacaggacagaucauuugggaccagcagacaaaggauaugguuuccugcaucuuucaauacaaacaguauaacgugacuaagcggaccgaagcggccaauggcgaguucuacaaccagacgguauauaaaaaggacccaaacgagaagagaaaacugauaucauugaagcaggggcucgauaccaaacuguacggagguuauucgggcgacaauccggcuuacauuguccuagugaagaucgaugacaaaaagaacaaacugguuaagaugcccaucaggcuugcagaacaaguggacaauaagacaauugaucuccagacuuggcuggaggaaaacgucccucacaaaaaggggauacagguguugaaaaccaagaucccacugggacagguaauuuacagcaaaaagaauggcuauuuagcccucaagucugacacagagaucgugaacgcucaacagcugguucuucccuacgguuaugucgcccuguugacucuccugcagaaaaugccugaaaauaaguacgaugaggugcuagcauguuaugacgaugggauucuggacaacaucuuuguggcgauaaucgauaaaaugaagcacuucuacccauauuacaguggcgagcuuaaaacccucuccgacaauauugauaacuuuaaggaaagccccgacgucaauaagaucaaaacgcugcaacaguuguuacugcuccugcaugccucuagcacaaccgcuuccauugaguucaacaauguuaagaaaaacucacuuggacguaagccgaauaguaucaacauacagaacacugaucuguugagcuuuucugccacaggccuauacgaaucccgcauucacaucgacuga

SEQ ID NO: 3052 - RNA, 4074 nt, Artificial Sequence
  Cas9 variant
auggccgcuaagaacuacaauaucggccuggacauugggaccagcuccauaggaugggcaaucguggaugacaacuaucagcucaugcacgccaaagguaaguacggcuaugggacaagaauuuacucugagggacaaacugcggcugauaggcggggcuuccgcacgacccgacguagacuuaauaggcggaaauggcgccugagauuguuacaggacuuuuucgaacccuauauccugccucaggaugaggccuuuuucauuaggcagaagcaaucaaaccuagucccacaggacacuaaaaagcaguacccggaaaguguucucuuugaugacacuagcgauaaggacuucuauaccgaguaccccacaaucuaccaucugcggcaggcacuuaugaccgaaaaucgccaauuugauauacgagagguguaucuggccauccaccauauuguaaaauacagaggucacuucuugaacaaugcuccugugaagacuuuuaaauccgggaaccucgaccuggcaaucaaguucaaugagcugaacgaagaguuuaaaucugucuauccagaucucgaauuacaguucaaucuggaccagauugacgagaucaagaagauacuuuuggauucgacaaaaucaagguuugaccggcagggagaggccgugaagcugauuuacaccguuagcgaagugaaaacgaucgagaagcuacaaaacaaaauugucaagcaguuccucaguggcauccugggccuuaauacucguuucgaugugcugaccaacacagaauccgacgauucuauguggaaauuuagcuuggacuccgagucaagugaugacgcucucgaugaaaucauugcccagcuggacgaucccgcgauacauguaguugaguuagugaaugagauccacagcucuauuacucuggcagggaucgucccugaaggacaaggucucuccgagucaaugguggaaaaguaugaggcccacaaggcucaucuucagcuguugaaagccguggaaaagcuagucgacaaaaaggcagcugacaaacuggagguugccuacgaucaguauauaaacggcaaggacagcaagcaguucauuaaagaggauuuuuacaaggcggugcaaagugaaaucaaagggguagccggagacgagguggcagaaaucaaccagcucauugagcuggaucaguucaugccaaagcagcgcaccaaagaaaauggcgcuaucccccaccaacuucaucagcacgagcuggacgucauuauagagaaccagucuaaguacuaugauugguugggugaaaagguggggaaugaguacaaacucgacaagcugguuuccuuuagagugccuuauuacgucggaccauuaguggauacagccagcaaagaaaagaaagacgagaccagguucgcuuggaugguacggaagaacccggagucgacggaagccaucacucccuggaauuuugaggauauuguugacaagaacgcaucugccgaaaauuucaucaaacgaaugacaaccaaggauaaauaucugcuaaacgaggacgugcucccuaagugcucccugcuuacucaggacuuugaagucuacaaugaguugaacaauauccgcgugaacggcgagaaauucacagcugaacaaaagcagcugauucacgaugagcucuuuaccaaacaugcgucagucaguauaaagcagcugaaggacuuccuugugagcgaacugauguauguuagagauaauuugaaaguggagggccucgcagacgaaaagaaacugauguccucuuuaagcacgcaguuugauuaccaaaagaucauuccagaccagaucaacgauguaaaauacagggaggacauugagcagaucauagaauggucaaccaucuucgaggaugccgcuauuuucaagacaaagcugaaagaaaucgacuggcuaacugaugagcaacggaauaagcucgccaacaaacgcuauagaggguggggaagucuguccaagaggcuuuuggcaugucuggucgacgaaaacggucagcguauuaucgauauacuccgggacagcucugacaauuuuaugaugauugugaaccgacccgaguucaaacaggccaucuuugaugagaaugcuaaccugaccgaaacaaauucaaagaaggacauguucgagaugauugauaacuuuuacacaaguccucagaauaaaaaggccaucagacaaguuuuacuggugguccaggacauacagaacgcaaugggcgggguggcgccacagaaaaucuucauugaauuugcuagggaggaugagguaaauggacgccggaccaacagcagauauucccaaaucagggaaauguacucuaaggugacagacgauguuauuaauaaaaccguccgcggcgagcuugaagccaacaaggguucguugaauaaggagaaacucuuccuguauuuucuacaagggggcaucgaccuguacagcggaaagacuauaaacauugauaauaucuccucauaugacguggaucacgugcucccccagaguuucaucaaagacgacucuauuaacaacaagguccugguuaaugcaaaaggcaaccgagugaagaaugauaacgugccgauggaacuuuuuggggccaaaauguacccuacguggaagcggaugguagacacaggaaucaugagcaaggcuaaauucaagaauuugacccugaaccccgauaaugucgacaaauuuaaggccgaggguuucauuaaccgucaguuaguggagacuagacagauaaucaaacucguugcacagauucugaaugauaaacuuggcgacgauaccaagaucguguccgucaaagcuaaccugacacaugacaugaggguguucuuugauuucccaaagaaucgcaacguuaauaacuaccaccaugccuuugacgcguauuugucagccuucguggggaccuaccucuauaaacgguacccuaagcugcagcccuauuuuguauacggagaguucaaaaagauggauaagcuaaagaauaugacuagcuuugacuuccugagagaucucaagcacacagacaaagucguggacaaggauacgggcgagauuaucgcugacaaacuggcagugauaaccaacaugaacaagaucuaugauuuuaagaaaguccuuguuacucacgaagugcaugaaaauucuggugccauguacgaccaaacauuguacccagcuaagcuggauaaauccuuagggaggaagggcgccaaacagcucauucccaagaaggacgauaugccuaccgcacuguauggaggcuacacagggaguaaagacgcguucaugagcaucguacgacuuaagaaaaaggaugaaguguauuacaaagucauuggaaucccagugcgcauagccgacucuguucagcacgguaaggagguggaugucgaggcucugacucaguuuauugaaaccaaauucacgaaggagaaccuaaauaagaaaaccggcgaaaucacacggaagguggagugguucgaacucguucugccgaaaguguuguuugggcaagccgucuucgacggaggccagcccuuuaugcuggguuccucaacuuauccucauaacuuaagagagcucguacugaccaaggauagugugaaaaagaucgcagggaaggagagcaauaaaucguaccuugacgcuuaugacgaaauuauggaggccaugaacaaguacuucccacuguacgauacaaauaaauuuagggaaaagguuauagagggccguuccaaauucaucgacuugcccgauaaggacgaguaugaaaacaauaagcucgugcaggucggaaaaucuacuauuaucgaucgcauguuuauuggccugcacgcaaacgccgcucggaccgaccuaaagaauaucgggauaacgacaccuuucggauuuaugcagcaagcgagcggcaucaaacugaccaaggauacugugguacuuuuccagucaaguacaggucucuuugagagaaaaguggcccugaaggacuuguga

SEQ ID NO: 3053 - RNA, 4077 nt, Artificial Sequence
  Cas9 variant
augaaggagcccuacggcguggggcuggacaucggaaccaacagcgucgguuggacaguuguggaugccuccggccacguaagaaaaauuaaggggcagacuggaauaggcgugaggcuguucaaagaaggugcugcagccgcggaccggcgcggguuucgaacgacccguagaaggcuuaagcgggucaaauggcgccugagauuguuaagggaguucuuugaucaaccuaucucuaagguggacauuaauuucuuugcucggcgcaaguauucagauguuaguccacgagacccgaacuacaauggacuggaaaagacacuauucaacgauagaagcgaccaggauuuuuaucaugacuaccccacuaucuaucaccucagggaggcccugaugacccagcaucggaaguucgaugugcgugaaauuuaccuugcaauccaccauauagucaaauaucgcggcaauuuucugagaaacgacgccgcuacagcauacagguccggcaccuuggaucuccagcaacacuucgagacucugaaucaccuguuuucucaggccgaccucgaguuaaaccugaaucuuacaaccgacguggcuuugcuggauucgaucaagcagacgcuaguacggacugacauuucacgaagcgaucgccagaaacucaucaugccucugcuugccguucugaccggggcgacaacugcagaaaagaagagacaaaaagccguggucaccgaguucgcuaaggccuuggugggaaacaaaacaaagauugacgugcucacccugacggauaucgacgcaacugaagcuaaagauugggccuuuaguuuagaggagaaucaggacaagcugccagguauagaagauagguucuccgaggucggccagcagauuaucgacgaaguuauucggcucuacgcgucugugaaccuugcccaacugauccccgaggggaaacgcuucagccaguccaugguagaaaaguauaagagacauggagaggauuugaaacuacugaaggcauacaucaggucacagagugacgcuaaacguggccgggccauucgagcuacauaugaccaauacauagauggugucaagagcaaacaggugacccaggaggccuuucagaaggcacucgggaaguucguggacgccgauguugaccucaauucuugggcugcgcaaaucaaacaggcaauugauuccgaacaguuuaugccuaaacuuagaacuaaacagaacggagccaucccauaucaagugcagcagaaugagcuggaccagauaauuucaaaccaaaaggaauacuaucccugguugggcgaggaaaacccugucaucaaaaggcgcggcaaguucccauacaagcucgaugagcuguuuggguuccgggugccguacuauguaggacccuuaaucacaaaagagaugcaggcugccaccgcaaaugccgguuuugcuuggaugguuagaaaggccgacggcccuauuacgccauggaacuucgaugacaaaguggauagggucgcaagcgcgaccgcuuuuauccagcgcaugcagacaacugacaccuaccugauuggggaagaggugcuacccgcccgaagucucauauaucaacgguucaugguccugaaugaacuuaacaauauccguguggaugacggacaguugacaccuagacagaagcaaaggcuguacaaccagguuuuuaaaaagcacaagcgcgugacugcaaagaauauucaggacaaccucguagccgcucgggaguucccaaccgcccccagaaucacaggccuggcagauccgaaggucuuuaauucuucccuuagcaccuaucaugaccugaaacagguguugccugaagcuaugucggauguuaggaagcaagccgacaucgagaaaauuauacucuggucuacuaucuucgaggauuccacgauuuucaagcagaaacugacagaaaucucaugguuaaccgcggcccagcugaagcagcuaggucaacuccgauaccgcggguggggccagcugcuucggaaguugcugacuggacucaaagacgauaacaauagaaguauuauggacggccugugggagaccaacgcuaauuuuaugcaguuaaggagccagcccgcaaucgaaaaccaaauaaaguccgccaaucaggcuaaccugacaaccgccgaucuucaggacacuaucaacgaguuguauacaucuccacaaaauaaaaaggcaauucgugaggugauggucgugcucgcggauaucaaagacgccaugcacgggcagacgccuaacuggauuuucguagaagcugcccgcggagguggcguggcagggcggagaacccagagcaggucaaagcagaucguugcugccuaccaaggaacugcacaggccauaguccgagaucaggugcagcgggagcugaaggagaaaauuaagaauaaagcuaacuuuaauacacgccuagugcuguacuuccuccaaaacggcagagaccuguauaccggugacgcgaucaauauugauaggcuuagugaguacgacaucgaucacauauugccccagucccuggucaaggacgauagcuuagacaaccggguucucacaaaugcccgaaucaacagagagaaaaaugauacuuuugcaucugaaaaguucgggaagaaaaugggcgcuaaguggaaagagaugcaucgcaugggacugaugaccaagaggaaacuugaccaccuguugaugcguccagaugaaauuucaaaguaugccacgggcuuuaucaaccggcagcucguggagaccagacaggugauuaagcugguagaggaacuaaucaaugccgaauaccccaguacagcuauagucagcgugaaagcaaaccugacucaucaauucaggcagaccuuugacuucccuaagauucgcgagguuaaugauuaucaccaugccuuugacgcggcucucacagccuucaucgggacuuaccugcuuaaacgauauccaaaguuggagagauuuuucguguacggaaaauucgcaaagcagccggucaaccugacccgguuuaacgugaucaggaaauuagccaagacggacacacccauuaccgauaucgacacuggugaaguucucugggauaagcugacagacauuaaauacuucgagacccuuuaugauuacaagcgccugcuagugacucgugaaguauccgagaauuauggcgcuauguuugaccagacccuccugaaagcaucugauaacgggaagagauugauacggaaaaagcaaucguucgacacagccaucuacggaggcuauacggguaagacccuggcguacauggcuauugucaaagugagcacuaagaaagaugugcaguaucaggucguuggggugccuacaaccaugguaacacaaaucgaacaguuagagcagcagggcaugacuaauaagcaagccgugaccaaagucauugagccacucaucgcagccaacaauaagaagaugcugacguacgaagugcuucugcccaaaguuagguuugaacaggugguccgcgaccgaauaaagggacagacacacagauucgcuuugggcaccgauacuuacuaucacaacauccaggaacucuaccugccucuaacccugcaacgggccuuucuugggaaacagaaugaguccgaggugcagcucaaccagaaucuguugacaguuuucgacgcaacucuggcucaagugaacagguauuuuccauuauacgaaaugaauaaguucaaaaagauucucaacucagcccgcgaucagaucgagcugcuugaagcgaagaaucaguuugucaaaaacaagcugguauugggaaaacaaggcauucucaccaauauguucaucggucugcaugccaacgcaaguuauggggaccuaaaggugcugggaguuaaaauagacuucggcaaacuucaggugcccgguggcauuaagcucacaggggaugcugagaucaucuaccagucuccgacgggacuguuugaaagaaaaauugccuugaaggacuuauga

SEQ ID NO: 3054 - RNA, 4077 nt, Artificial Sequence
  Cas9 variant
augaacgagcccuacggcguggggcuggacaucggaaccaauagcgucgguuggacaguuguggauaugaacggcagaguaaggaaggugaaagggaagacugcccucggagcucggcuuuucaaagaaggcgcaacggccgaggaccgccgagguuuucguaccacaagaaggcggcugaagcgcgucaaauggagauugagguuacugcgggaguucuuugaucagccuauuuccaagauagacccaaauuucuuugcgcgccgaaaguauucugauaucucaccgagagaccccaacuacaaugggcuagcuaaaacucucuucaacgauaggaccgaccaagaauuuuaucacgauuacccuacaauuuaucaucugcgggacaaacuuaugaccagugaucguaaauucgacauccgcgaaauuuaccuggccauccaccauauagugaaguauagaggaaacuuuuugaggacuggcccagcaagccaguacggcuccgccucucuccaccuggcuacaucguuccagaaacugaaugaucucuuugcacagucagaggagagcuuaaauuucaagcugguuaccgacgaagcccaacuucagcagauccagcaaauuuuggugcggacggaccugagucgauccgagcagcagcgccagaucuggccccuaauggucgugcucaugggggcuacugccgcggaaaagaaaagacaaaaggauuuugcaaaagagcuggccaacgcucuuguaggacugaaggccaaauugaauguugugacccucacaaacgucgacacuaccguggugaaggauuggacauucacccuggaggaaucucaggacaaauuaccugagauugaggaacagcugagcgaagucggucaacagaucauggaugagguuauacagcucuacgcauccgugaaucuugcucagcugauuccagccggcaagagguucucacaacauaugguagagaaguauaaccaccacgaaaagaauuuggagcuacugaaggcguacauccauagucagagcgacucuaaacgggggcgcgaaauuagagccacguaugauagguacaucgacggagugaaguccaaacccgucacucaggagauguuuuauaaggaucucaugaaguacguggaagcagacgcuacaucaaaccaccuggccgcugagaucaaagaugagauugacagcgaacaguucaugccuaaacuucguaccaaacaaaacggcaguauaccauaucagguucagcaguacgagcuggaccaaaucauuucucaucagaagaaauacuauccgugguugggugaagagaaucccguggccgaacggcgagggaaguuuccuuacaagcucgaugagcuggucggauucagagugccauauuacguaggccccuuaaucacuaaagaggaccagcaggcaacauccggcgccggguuugcuuggaugguuaggaaggcggauggaccuauaaccccauggaacuucgaccaaaaaguggaucgcauugcaagcgccacggcuuuuauccagcggaugcagaccacagacacuuaucugaucggugaagauguccuacccgccagaucgcucauuuaccaaagguucauggugcugaaugagcuuaacaauaugcgcgucgaagaccagaaguuggcaccgcgacagaaacagcggcuguauaaccaaguguuuaagcagcaccagcacguuucugugaagaauauccagcaaaaccucauggaugccggcgaguaccgugagaccccuaaaauuacagggcuggcugaccccaagggauucaauuccucacuuaguacuuaccaugauuuuaaaaagauacugccagaagccaucgcagacgagcacaaaagagcggauauugaaaagaucaucuuguggagcaccacauucgaggacuccgcuauuuuuaaacagaagcucgaagagguagccuggcugaccgacgcacagaggaagcaguuaucuggccugcgcuaucgggguugggggcaacuaagccauaaacuccugacugccuucaaggaugacaacggcagaucagucauggauggacuuugggagacgagugacaauuucaugcaguugaggaaacagccugcuauagaaacacaaaucaaggaggccaaccaggcaaaucugaccgaugcugacauucaggauacuaucaacgaacucuacaccagcccccagaauaaaaaggccauucgagaggugaugcugguuuuagacgauaucaagaacgcgaugcacggccaaacaccauccuggauauuuaucgaagccgcucgcgggggagguguggcaggccggagaacccagucuaggucaaaacagauugucgaggccuauaagaguacugcuaaagagaucgugagcgaaaagguacagcaugagcugaacgaaaagauuaaggccaaggcagacuucaauacacgucuuguguuguacuuucuccaaaacgggcgcgaucuguauacgaaugaggcgaucaacauagaccggcuauccgaauacgauauugaccacauccugccccagucucucguuaaagacgauucgcuggacaauagaguccuuaccagcgccaggauuaaccgagagaagaaugauacuuucgcuuccgagaaauuuggacggaagaugggcgcccaguggcgcgaauugcacagaaacggucugaugacacagaggaaauuaaagcaucuccugaugcggccugacgagaucucaaagcacgcaaccgauuucauaaaucgacaacuuguggaaacaagacaggugaucaaacuggucgaggaguugauuaguucugaauauccaagcgcuuccaucguugccgugaaggcaaaccucacucaucaguuucgccagaccuucaauuuuccgaaacugagggaggugaacgacuaccaccacgccuucgaugcuucacuaacggcguuuauugggauguaccugcucaagcaauaucccaaacuggaacguuucuuuguauacggcaaguucgccaaacagccuaucaaucuuacccgguucaacgucauaagaaaguuggcaguggcugaggaaccaauugccaauaucgagacaggagagauccugugggacaagacugccgauauuaaaugcuuugaaaaguuauauaacuacaaaaggcuccugguuacccaugaggugcgcgaaaacuauggcgcuauguucgaccagacaaucuuuaaggcaacugauagccgaaaaagacuuauucaaaagaagaaaggguucgccaccgagacguacggagguuauacaggccggacccuggcguaccuagcuauagucaaggugguuacuaauaaagacacacaguaccaggugguagggauccccaccacuauggucacccagauucaacagcucgaagccucuggacugacauccaagcaggcagugacgaaagccaucggcgcuaugauuaacgagaauaacaagaaguugcagaguuaugaggugcuguuaccuaaagucagguuugaacaaguugugcgcgacgagguaaagggucacauccaucguuucgcacucgggaccgauacuuacuaucacaauauacaggaacuguaccuuccacugacaauccagagagccuuuuugggcaaacggaacgacaccgaugcgcagacagagcaaaaucuccugacuguguucgaaaccacgcuagcucaggucaacagguauuuuccccuguacgagaugaauaaguucaaacagauucuuaacagcgcccaagagaaguuugcagcccucccgacaaagaauaaaaccgugaagaacaaacugguuacuggaaaggacggcguguugaauaaccuguucaucggguuacaugcuaaugccucucucggagaucugaaaauucuuggcaugaagaccgguuucgggaagcugcaggucccuggaggcuugaaacucacagaccaggcagaaaucauauaucaguccccaacuggucuguuugagcgcaagguggcucuaaaagaucuguga

SEQ ID NO: 3055 - RNA, 4077 nt, Artificial Sequence
  Cas9 variant
augaacgagcccuacggcguggggcuggacaucggaaccaauagcgucgguuggacaguuguggauaugaacggcagaguaaggaaggugaaagggaagacugcccucggagcucggcuuuucaaagaaggcgcaacggccgaggaccgccgagguuuucguaccacaagaaggcggcugaagcgcgucaaauggagauugagguuacugcgggaguucuuugaucagccuauuuccaagauagacccaaauuucuuugcgcgccgaaaguauucugauaucucaccgagagaccccaacuacaaugggcuagcuaaaacucucuucaacgauaggaccgaccaagaauuuuaucacgauuacccuacaauuuaucaucugcgggacaaacuuaugaccagugaucguaaauucgacauccgcgaaauuuaccuggccauccaccauauagugaaguauagaggaaacuuuuugaggacuggcccagcaagccaguacggcuccgccucucuccaccuggcuacaucguuccagaaacugaaugaucucuuugcacagucagaggagagcuuaaauuucaagcugguuaccgacgaagcccaacuucagcagauccagcaaauuuuggugcggacggaccugagucgauccgagcagcagcgccagaucuggccccuaauggucgugcucaugggggcuacugccgcggaaaagaaaagacaaaaggauuuugcaaaagagcuggccaacgcucuuguaggacugaaggccaaauugaauguugugacccucacaaacgucgacacuaccguggugaaggauuggacauucacccuggaggaaucucaggacaaauuaccugagauugaggaacagcugagcgaagucggucaacagaucauggaugagguuauacagcucuacgcauccgugaaucuugcucagcugauuccagccggcaagagguucucacaacauaugguagagaaguauaaccaccacgaaaagaauuuggagcuacugaaggcguacauccauagucagagcgacucuaaacgggggcgcgaaauuagagccacguaugauagguacaucgacggagugaaguccaaacccgucacucaggagauguuuuauaaggaucucaugaaguacguggaagcagacgcuacaucaaaccaccuggccgcugagaucaaagaugagauugacagcgaacaguucaugccuaaacuucguaccaaacaaaacggcaguauaccauaucagguucagcaguacgagcuggaccaaaucauuucucaucagaagaaauacuauccgugguugggugaagagaaucccguggccgaacggcgagggaaguuuccuuacaagcucgaugagcuggucggauucagagugccauauuacguaggccccuuaaucacuaaagaggaccagcaggcaacauccggcgccggguuugcuuggaugguuaggaaggcggauggaccuauaaccccauggaacuucgaccaaaaaguggaucgcauugcaagcgccacggcuuuuauccagcggaugcagaccacagacacuuaucugaucggugaagauguccuacccgccagaucgcucauuuaccaaagguucauggugcugaaugagcuuaacaauaugcgcgucgaagaccagaaguuggcaccgcgacagaaacagcggcuguauaaccaaguguuuaagcagcaccagcacguuucugugaagaauauccagcaaaaccucauggaugccggcgaguaccgugagaccccuaaaauuacagggcuggcugaccccaagggauucaauuccucacuuaguacuuaccaugauuuuaaaaagauacugccagaagccaucgcagacgagcacaaaagagcggauauugaaaagaucaucuuguggagcaccacauucgaggacuccgcuauuuuuaaacagaagcucgaagagguagccuggcugaccgacgcacagaggaagcaguuaucuggccugcgcuaucgggguugggggcaacuaagccauaaacuccugacugccuucaaggaugacaacggcagaucagucauggauggacuuugggagacgagugacaauuucaugcaguugaggaaacagccugcuauagaaacacaaaucaaggaggccaaccaggcaaaucugaccgaugcugacauucaggauacuaucaacgaacucuacaccagcccccagaauaaaaaggccauucgagaggugaugcugguuuuagacgauaucaagaacgcgaugcacggccaaacaccauccuggauauuuaucgaagccgcucgcgggggagguguggcaggccggagaacccagucuaggucaaaacagauugucgaggccuauaagaguacugcuaaagagaucgugagcgaaaagguacagcaugagcugaacgaaaagauuaaggccaaggcagacuucaauacacgucuuguguuguacuuucuccaaaacgggcgcgaucuguauacgaaugaggcgaucaacauagaccggcuauccgaauacgauauugaccacauccugccccagucucucguuaaagacgauucgcuggacaauagaguccuuaccagcgccaggauuaaccgagagaagaaugauacuuucgcuuccgagaaauuuggacggaagaugggcgcccaguggcgcgaauugcacagaaacggucugaugacacagaggaaauuaaagcaucuccugaugcggccugacgagaucucaaagcacgcaaccgauuucauaaaucgacaacuuguggaaacaagacaggugaucaaacuggucgaggaguugauuaguucugaauauccaagcgcuuccaucguugccgugaaggcaaaccucacucaucaguuucgccagaccuucaauuuuccgaaacugagggaggugaacgacuaccaccacgccuucgaugcuucacuaacggcguuuauugggauguaccugcucaagcaauaucccaaacuggaacguuucuuuguauacggcaaguucgccaaacagccuaucaaucuuacccgguucaacgucauaagaaaguuggcaguggcugaggaaccaauugccaauaucgagacaggagagauccugugggacaagacugccgauauuaaaugcuuugaaaaguuauauaacuacaaaaggcuccugguuacccaugaggugcgcgaaaacuauggcgcuauguucgaccagacaaucuuuaaggcaacugauagccgaaaaagacuuauucaaaagaagaaaggguucgccaccgagacguacggagguuauacaggccggacccuggcguaccuagcuauagucaaggugguuacuaauaaagacacacaguaccaggugguagggauccccaccacuauggucacccagauucaacagcucgaagccucuggacugacauccaagcaggcagugacgaaagccaucggcgcuaugauuaacgagaauaacaagaaguugcagaguuaugaggugcuguuaccuaaagucagguuugaacaaguugugcgcgacgagguaaagggucacauccaucguuucgcacucgggaccgauacuuacuaucacaauauacaggaacuguaccuuccacugacaauccagagagccuuuuugggcaaacggaacgacaccgaugcgcagacagagcaaaaucuccugacuguguucgaaaccacgcuagcucaggucaacagguauuuuccccuguacgagaugaauaaguucaaacagauucuuaacagcgcccaagagaaguuugcagcccucccgacaaagaauaaaaccgugaagaacaaacugguuacuggaaaggacggcguguugaauaaccuguucaucggguuacaugcuaaugccucucucggagaucugaaaauucuuggcaugaagaucgguuucgggaagcugcaggucccuggaggcuugaaacucaccgaccaggcagaaauaauuuaucaguccccaacaggucuguuugagcgcaagguggcucuaaaagaucuguga

SEQ ID NO: 3056 - RNA, 4077 nt, Artificial Sequence
  Cas9 variant
augaaggagcccuacggcguggggcuggacaucggaaccaacagcgucgguuggacaguuguggaugccuccggccacguaagaaaaauuaaggggcagacuggaauaggcgugaggcuguucaaagaaggugcugcagccgcggaccggcgcggguuucgaacgacccguagaaggcuuaagcgggucaaauggcgccugagauuguuaagggaguucuuugaucaaccuaucucuaagguggacauuaauuucuuugcucggcgcaaguauucagauaucaguccacgagacccgaacuacaauggacuggaaaagacacuauucaacgauagaagcgaccaggauuuuuaucaugacuaccccacuauuuaucaccucagggaggcccugaugacccagcaucggaaguucgauguucgugaaaucuaccuugcaauacaccauaucgugaaauaucgcggcaauuuucugagaaacgacgccgcuacagcauacagguccggcaccuuggaucuccagcaacacuucgagacucugaaucaccuguuuucucaggccgaccucgaguuaaaccugaaucuuacaaccgacgucgcuuugcuggauucgauuaagcagacgcuagugcggacugacaucucacgaagcgaucgccagaaacucauuaugccucugcuugccguacugaccggggcgacaacugcagaaaagaagagacaaaaagccguugugaccgaguucgcuaaggccuuggucggaaacaaaacaaagaucgacgugcucacccugacggauauagacgcaacugaagcuaaagauugggccuuuaguuuagaggagaaucaggacaagcugccagguauugaagauagguucuccgaggugggccagcagaucauugacgaagucauccggcucuacgcgucuguuaaccuugcccaacugauccccgaggggaaacgcuucagccaguccaugguggaaaaguauaagagacauggagaggauuugaaacuacugaaggcauacauuaggucacagagugacgcuaaacguggccgggccauacgagcuacauaugaccaauacaucgaugguguaaagagcaaacaggugacccaggaggccuuucagaaggcacucgggaaguucgucgacgccgauguggaccucaauucuugggcugcgcaaauuaaacaggcaaucgauuccgaacaguuuaugccuaaacuuagaacuaaacagaacggagccauaccauaucaaguucagcagaaugagcuggaccagauuaucaacaaccaaaaggaauacuaucccugguugggcgaggaaaauccugugaucaaaaggcgcggcaaguucccauacaagcucgaugagcuggucggguuucgggugccguacuauguaggacccuuaauuacaaaagagaugcaggcugccaccgcaaacgccgguuucgcuuggaugguuagaaaggccgacggcccuaucacgccauggaauuuugaugacaaaguggauagggucgcaucagcgaccgcuuucauucagcgcaugcagacaacugacaccuaccugauaggggaagaggugcuacccgcccgaagccucaucuaucaacgguuuaugguccugaacgaacuuaauaacauucguguggaugacggacaguugacaccuagacagaagcaaaggcuguacaaucagguuuucaaaaagcacaagcgcgugacugccaaaaacauccaggacaaucucguagccgcuggcgaguuuccaaccgcaccccggaucacaggucuggcagauccgaaggucuucaacaguucucuuuccaccuaucaugaccugaaacagguguugccugaagcuaugagcgauguuagaaagcaagccgacauugagaaaauaauccucuggucgacuauuuuugaggauucuacgaucuucaagcagaaacugacagaaauuuccugguuaaccgcggcccagcugaagcagcuagggcaacucagguaccgaggcuggggacagcugucacgcaaacuuuugacuggccugaaagacgauaauaaccggaguaucauggacgggcucugggagaccaaugcuaacuucaugcagcugagaagccagcccgcaauagaaaaucaaaucaaguccgccaaccaggcuaacuuaacaaccgccgaucugcaggacacuauuaaugagcuuuauacaucuccacaaaacaaaaaggcaaucagggaggugauggucguguuggcggauauuaaagacgccaugcacggacagacgccuaauuggaucuuuguagaagcugcccgugguggcgggguggcaggacgccggacccagagcagaucaaagcagauaguugcugccuaccaaggcacugcacaggucauugugagugaucaggugcagagggagcucaaggaaaagaucaagaacaaagccaauuucaacacacgacugguccuauacuuucugcaaaauggucgggaccucuauaccggggacgcuauuaacaucgaucgccuguccgaguacgacauagaucacauccuuccccagagcuugguuaaggacgauucucuggacaauagaguguuaacaaacgcgaggauuaaucgggaaaagaacgauacuuucgccucagagaaguuuggcaagaaaaugggagcaaaguggaaagagaugcaucgaaugggccucaugaccaagagaaaacuggaccaccuucugaugcgcccagaugaaaucaguaaguaugcuacgggguucauuaauaggcaguugguggagacccgucagguaaucaagcucgucgaggaacugauaaacgccgaauaccccagcacagccauuguguccguuaaagcuaaucuaacucaucaauuucggcagaccuucgacuuuccuaagaucagagaggugaacgauuaucaccaugcauucgacgccgcgcugacagcuuuuaucggaacuuaccuccugaaaagguauccaaaacuugagcgcuucuuugucuacgguaaauucgccaagcagccggugaacuugacccgauucaauguuauuagaaaacuggcaaagacggacacacccaucaccgauauugacacuggcgaaguguuaugggauaagcucacagacauaaaauacuuugagacccuguaugauuacaagcggcuucugguaacuagggaagucucugagaacuauggggccauguucgaccagacccuacucaaggcuucggauaauggaaagcgccugauccguaaaaagcagagcuuugacacagcaauuuacggcgguuauacggggaagaccuuggccuacauggcgaucgugaaaguguccacuaagaaagauguccaauaucagguugugggcguaccuacaaccauggugacacaaauugaacagcuggagcagcagggaaugacuaacaagcaagcugucaccaaagugaucgagccauuaauagccgcaaauaacaagaagaugcucacguacgaaguucugcuucccaaagugagauucgagcaggucgugcgggacaggaucaagggccagacacaccgcuuugcccuggggaccgauacuuacuaucacaauauucaggaauuguaccucccucugacccuacaacgagcuuuccugggaaaacagaacgagucagagguucagcuuaaucagaaccuccugacaguguuugacgccacuuuggcacaagucaauagauauuucccacuguacgaaaugaacaaguuuaaaaagaucuuaaauagugcucgggaucagauugagcuccuggaagccaagaaccaguucguaaagaauaaacuugugcugggcaaacaagguaucuugaccaacauguuuauagggcuccaugcgaacgccucuuucggagaccuaaagagccugggcguuaaaacauccuucggucagcuucaggugcccggcgggauuaaacugacgggagacgcagagaucaucuaucagucaccgaccggccucuuugaaaggaagauugcucugaaagauuuguga

SEQ ID NO: 3057 - RNA, 4077 nt, Artificial Sequence
  Cas9 variant
augaagcagggcaaaagaggguacuaucugggacucgacaucgguaccgauagcauuggcuacgccgugacagacgagcaauaucaccuucugagguuccaugggaacgaugcuuggggaucccacgucuuugacucugcaucauugugcgaugaacggcgcggcuuccgaagugcccguagaagguuagaccggcgccagcagagaguuaagcugcuacaggagauauuugcgaaagaaaucgcuaauauugaucccagguucuuuauccggcucagcgaguccuaccgcuggcgagacgauacugacgauagauauauuuacuucaacgaagaggaguauacggacauccaauacaugagggauuacccuaccauacaucaccugaucugugaacuuauggagaaugaagaggagcaugacauucggcugguguauuuggccugcgcauggcucguagcccaccguggucacuuucugucucagcugucgguggacaacaucgauucacucauugacaucgaaagcgucuaccagaaguucuuacauuucuucauagauaaugggugugagaacccauggauucaggacgcugaacuggugggaggcauccuuaaagagcacauuggcguuacagaaaagcauaaucgcuugggggagaucaugcugggaaacagaaagccgaguaaagaugugagggacacuuuucuauauuccgaguacugcaucauucggcuccuggcugguggcaccuguaaacuucgagaucuguaugggaaagaagaguacgaagacuucggaucugucagcuuggagauggaugacgauaagcucgccgaaauaaugaucaauauuggcgaggacuaugagcugaucgcuguguuacgcucccugcacgacuggucaguacucgccgauauacuugacggucaaaacgggcugacaaauauuaguaccgcgaaaguugcaaucuacgaacagcacaagaaggauuuggccacucuaaaauacuuuaucagaaaguauugccccgagaaauacaacgcuauuuucaaggacgccagggaagauaauuauguggcauacagcuaucauuacaacaauaaacuggacggacagaucaagaaaaaggcugauacagagaccuucucuaaguuucucauuaaaauaauccacuccauuaagccugacaaagaagaugagaucaucuaucaggacauggauaaccggcugggccuucgccaauuccugccaaagcagagaaacacggacaauagggucauuccccaucaguuguacgaguacgaacucaaaaagauacuggagaacgccgcgaaguauuuaucauuucugaaucaaaaagaagauggcaucagcaacacugagaagauuaucaguauuuucaaauuuaagaucccuuacuauguggggccacuaaauaaacacucugaguucgccuggauagaccguaaguccggaaagauccuccccuggaacuacgaaaauaugauugacgaugacgcaagcgaggaggcuuuuaucaaaaagaugaccaaccaguguacauaucugccuggugaaucggugcuuccaaaagauucuuugugcuaccagaaguucaugguccugaaugaaauuaacaauaucaaaguugacggccggaagauauccgugggggccaagcagggaauuuauucagaucucuuucugaaauacaagaaaguaaagcgaagucaaaucgaggaguaccuuauuagcaacggccagcuggaaaagaauagaagggagacuuuguccgguaucgacauacagaucaagucuagccucucaagucauauugcuuuccgccggcuguuagaacagaaaauccugaacgaggccgauguggaaagaauuaucgagagggcauccuaugccgaggacaaggggcgcgucgcuaaguggcuacgagcgaaauacccgcaccucaccgaagcagauauaaaguauauuuguaaagugaagaucaaagacuuuggccggcugagccguacauuccuuaccggaaucgagggcgccugcaaggaaacgggggagguugcuacuauuaucucuaugaugugggaaucaaaugauaacuugauggagcugcucagugagagauacacauuugccgacaccauucuggaauuuaagagcgauuauuacacugagaggaaacaaacauuauccgaacgccuggacgagauguaugugucuaacgcaguccggagacccauauacaggacccuugacaucgugaaggauuuggagaaagccuucggaaagccugagaaaauuuuuaucgaaaugacgcgaggugcuaugccagaacucaagggcaagcgcaccaaaucgcggcagcagcagcugcuagaguacuaugacaaguguaaagaagaggauguaagagaccugaagcaacagcucgaggcccugggggaauacguugauaauaaacuucagagcgacagguuguuccuguauuuuaugcaguucggaaagugcgcauacuccggcaugcccauuucauuagagcgucucauggcggguaguaaggaauaugauaucgaccacauauacccucaagcauaugugaaagaugacucuaucauuaacaauaagguccuggugcuuagcgucgccaacggggagaaaaaggauguguacccaaucaaauccgaaauucgcaauaagaugcagaaaacauggucauuuuggcaucacguuggcacuaucagcgacgagaaguacaagcggcugauaagaucuacccccuucacagaggacgaaaaauauggauuuauuaacaggcaguugacugagaccucccaaaguacaaaggugguagcagaacuccugaaagagcgauacccggaagccgagaucgucuauagcaaggcuggccuaaucucugauuuccggcaugaguuugaccuguacaaaucccgcucauauaaugaucuccaccacgccguggacgcauaccugaacauuguuguggggaaugucuaucauaugagauucaguaggcagugguuuaacgugaauagcucguacuccauaaagaccaagacucuuuucacgcacacaguaaacugcaauggaaaagaaguguggaacaaggauauguugccugguguucugaaaaccgcuaagaaaaauacugcccauuuuaccaagcacgcgacauucaagaccggcggguuauucgaccagaaccccgucaaaaaggccccaggacucacuccucugaaagcuggccuucccacagagaaguacgguggguauaacaaagcaggcgugauguuuuucaucccagugcgguacaagucuggaaagaaaacgguccugaugguucuaagcguggaacuccuguauggcaaucgauuuuuggaggaugagauuuucgccaaggaauacgcuaaagacagacugcagcgcaugaucgggaagucaguggaugagauugacuuucccaucggaaugaggccuuggaaaguaaacaccauauuaagucucgauggcuuccguaucuguauuacugguaaugccuccgggggaaagugccugaucgcacaaccaauuaugcaguuuucuagcgacgaauauuggaaguacuaucuuaaaaaggucgagaaauucguggaaaagguuaaaaacaauuccucauacguguacgaugucgacuaugacgcggugcagcaugaggauaaccugaaguuguacgaccucuaucuggauaaacuacagaauagcaucuaccggaagagaauaaacgccccgauucaaacacugaucgagggcagggaaaaguuuaucgacuguaguguuauugagcagugccaggugcuucucaauauccaccagguauucggucgcaugaccucuggcugugaucugacauugauagggggaaaaacucgauccgcuagcaccgucaacuuuucgucaauuauccugaauuggaagaaaaacuauacggacgugagaauuaucgaucaaucugccaguggcuuaugggaaguggucuccgagaauauacucgaauaccuguga

SEQ ID NO: 3058 - RNA, 4077 nt, Artificial Sequence
  Cas9 variant
augggcaagauguacuaucuggggcucgacaucggaaccaacagcguggguuacgccgucacagaucccuccuaucaccuucugaaauucaagggcgagccuauguggggagcucauguuuuugcagccgggaaucagucugcggaaagaaggucauuccggacuagccgccgacguuuggacagaaggcaacagcgggugaaauuaguacaggagauuuuugcuccagugauaagcccgaucgauccccgcuucuuuauuagacugcacgaauccgcccuauggagggacgaugucgcagagacggacaagcauaucuucuuuaacgauccuaccuacacagacaaagaauauuacucugauuauccaacuauucaccaucucaucguggaccugauggagucgucagagaagcacgauccccggcuuguuuaccuggccguggcuugguuggucgcacaccgcggccauuuccucaaugaaguggacaaggauaacauaggugacguacugagcuuugacgccuucuacccugaguuucuggcuuuccucagugauaaugggguuuccccaugggugugcgaaucuaaagccuuacaggcgacccugcuuagccgaaacuccgucaaugacaaguauaaagcauugaagucacugaucuuuggaagucaaaaacccgaggauaacuucgacgccaauauuagcgaggauggccuaauccagcuccuggcuggcaagaaggugaaagugaacaaacuuuucccucaggaaucuaaugacgccuccuuuacacugaacgauaaagaggacgcaauugaagagaucuuggggacccucacuccagaugaaugugaguggauagcucacauuagaaggcuguucgacugggccaucaugaagcaugcguuaaaagauggacggacaauuucagagagcaaggucaaacuguacgaacagcaccaccaugaccucacccaacuuaaguauuuuguuaagacguaccuggccaaagaguaugacgauaucuuccguaauguggacagugaaacuaccaagaacuacguagcauauucuuaccacgugaaagaggucaaggguacauugccgaaaaauaaggcuacucaggaagaguuuugcaaguacgugcuaggcaaaguuaagaacaucgaguguuccgaagccgauaaaguggacuucgaugagaugauucagcgccugaccgacaacagcuuuaugcccaagcaggucucgggggaaaauagagugauaccuuaucaacucuacuauuacgagcugaaaacaauccuuaacaaggcugccucuuaucugccauucuugacccagugcggaaaggaugcaauuuccaaucaggacaaacuccugucaaucaugacguuuaggauacccuacuucguaggcccuuuacggaaggauaacagugaacaugccuggcuggagcgaaaagcugguaagauuuauccauggaauuuuaacgacaaaguugaucuagacaagagcgaggaagcguucauccgcagaaugacuaauacauguaccuacuaccccggggaggaugugcucccgcuggacucccuuaucuaugaaaaguuuaugauuuugaacgagaucaauaacauuaggauagacggauacccuaucucugucgaugugaaacaacaggucuucggccuguucgagaagaaacggcgcgugacuguuaaggacauucagaaucuccugcuuagccugggcgcauuggauaaacacgggaagcucacaggaaucgacaccacgauccauucaaacuauaauaccuaccaccacuuuaaaagucugauggaaagagguguguuaacaagggaugacguagagcguauugucgaacggaugacuuauuccgaugacaccaagcgagugagacuguggcuaaacaauaacuacggcacacucacugccgaugacguuaagcauauaagcaggcugcgcaaacacgauuucgggcggcuuucuaagauguuuuugaccggacugaaaggcgugcauaaggagacaggugaaagagcuucaauccucgacuucauguggaacaccaaugauaaccugaugcaguuacugagugagugcuauacuuuuagcgacgagauuacgaaacuucaagaagccuacuacgcaaaggcccaguugucccucaaugacuuccuggauucuauguauaucucgaacgcugucaagaggcccauuuaccgcacacuagccgugguaaaugacauccgaaaagcaugugggaccgcgccaaagcggauauuuaucgagauggcucgugauggcgaaagcaaaaagaaaagauccgugacuaggcgcgagcagauuaagaaccuguaucggucaaucagaaaggacuuccagcaagaaguugauuuucucgagaaaauucuggagaauaagagugacggacagcuucagucugaugccuuguaccuguauuucgcacaguuaggcagggacauguacaccggggauccuaucaaacucgaacacauaaaggaccaaaguuuuuauaacauugaucacaucuacccccaguccauggucaaagacgacucacuggauaauaaggugcuugugcagagcgagauuaacggagaaaagucuucccgauacccacuggacgccgcuauccgcaauaaaaugaagcccuugugggaugccuauuacaaccauggucucauaagucugaaaaaguaucagcggcuaacaagaagcaccccuuucacugacgaugagaaaugggacuuuaucaauaggcaacuggucgaaacacgucagucuacgaaggcacucgcuauucugcuuaaacgcaaguucccagauaccgagaucguuuacuccaaggccggcuugucaagugacuuccggcacgaguuugggcuggugaaaagcagaaacauuaaugauuuacaucacgcgaaggacgccuuccucgcuaucgugacuggaaacguauaucaugaaagguuuaaccgacggugguucauggucaaucagccguacucggugaaaacaaagacccuguuuacacacuccauaaagaacggcaauuucguugcauggaacggugaggaagaucuugggcgcauugugaagaugcugaagcaaaauaaaaacacuauccacuuuaccagauucucuuuugacaggaaggagggccuauucgauauccagccccucaaagccagcacgggacuggucccucggaaggcuggcuuggacgugguuaaauaugggggauacgacaagucaaccgccgcauacuaucuguuagugcgauuuacacucgaggauaagaaaacucagcauaagcugaugaugauuccaguagaaggucuuuacaaagcgagaaucgaccacgauaaggaguuccugaccgacuaugcccagacaacuauuagugaaauauugcaaaaagauaagcagaaggucaucaauauuauguuccccaugggcacccgccauaucaaacucaacuccaugauuucuaucgacggguuuuaccugagcauaggaggcaaguccucaaaagguaagagcgugcuaugccacgcuauggugccucugaucgucccacauaaaauugaguguuauaucaaggccauggaaaguuucgcaaggaaguuuaaagagaauaacaaacuucguauuguugagaaguucgauaagaucacgguggaagacaaucucaaccuguacgaguuguuucugcagaaauuacagcacaaucccuauaacaaguucuuuucuacacaauucgauguacucaccaaugggcgguccacuuuuacaaaacugagcccggaagaacaggugcagacccuucugaacauauugucgauuuucaagacuugcagaucaucuggcugugaccucaagaguaucaacggauccgcucaggccgcaaggaucaugauuagcgccgaucugaccggccuaucuaaaaaguacagcgacauacgccuggucgagcaauccgcuucagggcuuuuugugaguaaaagccagaaucuccuggaguacuuguga

SEQ ID NO: 3059 - RNA, 4083 nt, Artificial Sequence
  Cas9 variant
augaccaagcugggcaaacccuacgggaucggaguggacauugguagcaacuccauaggcuucgccgcugucgaugaaaauucucaccucaucagacuuaaggggaaaacaguuauuggagcaaggcuguuugaagagggcaaggccgcggcugaccggcgcgccucacgaacuacgcguagaagguugagucggaaccgcuggagacugagcuuccugagggacuuuuucgaaucccauaucaccccuacagauccaaacuuuuucaugcggcagaaauauucugagauuucgccgaaggauaaggcacgcuacaaauaugaaaagcgacuauuuaaugacagaacugaugccgaguucuaccaacaguaucccaccauguaccaccucaggacacggcugcuuaccgacccuucaaaagcugaugugcgugagaucuauuuugcaauacaucacaucuuaaagagccgcggucauuucuugacaaguggguacgccaaagacuuuaauacuaacaagguagcucucaaugaaauuuucccagcccugcaggaugcguacgcacagguguaucccgaccuggauaucaccuuugacgagaacaaggucaaugaguucaaaacggugcucuuagacgagaaggccacuccuuccgauacccaaagagcucugguuaaccuuuugcuggccgaggacggagauaaagacauucuaaagcagcagaaacaggugcucacagaguucgcaaaggcugucgugggccugaaaacuaaacuuaauguagcccugggcaccgaaguugauucuagcgaagcgacagccuggaacuuuuccuuggggcaacucgacgauaagugggcaggaaucgagucagcuaugaccgacgaagguacggagauacuggaucagauuagggacuuauaccgggcccgacugcucaauggcaucgugccagcugggaaaacucuuagucaggccaaggucgaugacuaugagcagcaccacgaagaccuggaguuguucaaagauuaccuaaagcaacuggaagacgauggaauggcaaaagccauucgccagcucuaugacagauacaucgauggcgacgaugcuaagcccuuugugagggaggacuucgugaaggcgcugacaaaagaagucaccgcacauccuaacgccaagagcccagagcuucuggagcgguugguucagccggauuuuaugcucaaacaacgcaauaaggcuaacggugccauccccgugcagaugcagcagagagaacuggaccaaauuauaaagaaccagucuguauauuacgauugguuagcagccccuaauccaguggagaagcacaggcaguccaugcccuaccaguucgacgaacugcuaaacuuucguaucccuuauuacgucgggccacucgugacugcuaaggagcaaaaagccgcacagggaggcguuuucgcguggauggugcggaaggaucccgacggcaauauuacaccguauaacuuugacgaaaaagucgaucgagaggcuucagccaauaccuucauccagagaaugaagacgaccgacacauaccugauaggggaggaugugcuuccuaaacagagcuugcuguaucaaaguuacgaaguacucaacgagcugaauaacguuagggugaaugacaacaaacuuucuuuugaucagaagcagcagguccugggagaauuguucgagcgccauaauacugugaccauuaaacaauuugucgacaaccuccuggcacacggugauuaugaccggauccccgaggugagaggcuuagccgaugaaaagagguuccuguccagccuaucgacauacaaucagcucaaagggauccugcacgaggcuauugacgauucugacaagcagacugauaucgaaaagauuauagccugguccaccaucuucgaggacaaggcaauuuuuaaaacaaaacuuaacgaaaucucaugguugaaugcuggaaugaucaacagucuggccaacauucgcuaccgaggcuggggucaauucagccauaagcuccugaaugaguuaacccuguccacugggcggacgguuuuugaggaacuuuugauaucuagccacaaccucaugcagauccugacagacgaggugcuaaaacagaagauugcggaacugaaugcccaugagcucaaggcuucaggcaucuaugcagccauugaugacgcuuacaccaguccauccaacaagaaagcccugcgucagguacuuagcgucaucgaugacauaacuaaugcagcgggacaagccccuaacugguuguauaucgaaaccgcugauggcgacggggugcccggaaagagaacaaauucuaggcagcgcaagauucaggagaucuacguuaacgccgcacaggagcugauuaccgguucagugcggggcgaauuagaggauaaaaucgcuaguagagccgacuucacugauaggcucguccuguauuuuaugcaagggggacgagacauauacacaggcgaaccacuuaauauugauaaccugagcuccuaugacaucgaccacauuuugccccagucucucaucaaggauaauucgcuggacaaccgcgugcuaguacauccucuggugaaucgggagaaagauacgauauucgcaagcaccagauuugccaagcagaugaacgguauguggaggcaguggcacgcugcggggcucaucuccucacguaaacugcgcaaucuucaaaugcggccagacgaaauugauaaguacgccaguggcuucguugcaagacaguuggucgagacuaggcagaucauuaagcugacagagcaaaucguggcugaccaguacccggaugccaaaauaauugccgugaaggcuggauuaucuagccagcuccgaaaagaacuggacuuucccaagaaccgggaggucaaccacuaucaucacgcauucgaugccuuucuugcggcucgcaucggcaccuaccugcuaaaaagauauccuaaucucgaaccauucuuuacauacgggaaguucaagaaaacugagguuaagaaacugaaguccuucaacuuuaucagggacaugacccaugccaaagauaagauuguggcaaaagagacgggagaaaucgugugggacaaugccucagauauuaacgaguuggaccggauauauaauuucaagcgaaugcugaucacccacgaaguaagauuugagacagcuagcuuauucaagcagacucucuacgcagccaaaaacucuaagaaucgcgguggcuccaggcaacugauucccaaaaagaaaggguaucuugucgacaucuacggaggcuacacccaggaaacagguaguuaucugagcgugguucguuugacuaagaaggcgauguacgcuguggucaaagugucuacccgggaugccgcaaagcucgccguugcuaaauccauuucagagcagaaggagaacgaaacgcugaaaaagaucauagacgggaagcuaaguaaaacaagcaagaaaggcaagaccacucaccagcuguuugagaucgugcuuccuagaguaggacagaaaacacucuucaaaaauucgaaguauaaccaauuucuggucaauuccgauaccuacaugcauaacuaucaggaauuguggaugccaagggaguaccagcgcauguggaaagacauucuguuaucuaaucacggcgaugcccaacucgaagggcagcuggaccagaucuucaaguuuauugugagccaggugaacucauauuucaaucuuuacgauaucaaccaauuucgaaagaagauagcagacgcuacugauaaauucgccaagcugcccacccaugacacagauaacgcgagaggaaagauugccacgaucggccaguugcucaucggucugcaggcaaaugcuaugcggagugaccuaaggaaccuggauauuaaaaccccguucgggcuucuccaaauaggaacuggcaucacacuggacuuggacaccuccauuaucuaccagucuccuacagguuuauuugagcgcgaggucccacugacugaucucuga

SEQ ID NO: 3060 - RNA, 4083 nt, Artificial Sequence
  Cas9 variant
augaccaagcugaaccagcccuacggcaucgggcucgacauuggaagcuccucuauagguuucgccguggucgaugcuaauucacaccuucugagauugaaaggcgagacagcaaucggggccagguuauuucgggaaggagagagugcggcuggccgccgagccagccguacuacgagaaggcggcugucccauaaccgcuggagacuaagguuccuccaagacuuuuucgauccucacauuucuucgaucgacccagauuucuuccugcggcagaaguauucagaaauuagcccgaaagacaaggagcgcuuuaaauacgaaaagcgacuuuucaaugauagaaccgacgcacaguuuuauaagcaguaccccacaauguaucaucugagguugcaccucaugaacgaugccaguaaagcugacccucgggagaucuucuuugcaauacaucacauccugaagucccguggucacuuccugacuccaggggaugccaaaaauuuuaacaccgacgauguugaccucaagcauauuuuccccgcuuuaacagaggccuacgcgcaagcauauccugaccugacccuuucuuucgaaccaagcaaagccgagaaguuuaaguccaucuugcuggaugaagacgcuacuucaaaugauacacagaaagcccuagugaagcuccugcuuagugacgauggagacaaagagguacugaagcagcagaaaaagguguugaccgaguucgcaaaagcugucgccggccucaaggugaaguuuaacguugcgcugggcauugaagugacggaugccgacgucgagaaauggcacuucgggauggcacaauuagaagauaaguggagcgacaucgagcccucucugacugaucagggaauggaaauauuugagcagauucaggaccucuaccgcgcuagacuucugaaugguaucgugccugccggcaaaaccuugucccaagcuaagguagacgauuacgaccagcauugcaaagaucuaaagcuguucaaggaguaucucaaacagcugaacgaccacgaucuugccaagaggauucggcuguuguacgaccgauauaucgauggggacgaugcaaaaccauuucuccgcgacgauuucguuaaggcccugaaaaaggaagugacagcucacccgacugaguuagcggaaucacugcuagagagaauggaacaagacaauuuuaugcucaagcagaggaccaaagcaaacggaagcauccccguccagaugcagcaacgggagcuggauaagauuauagccaaucaggcugaguacuauaguuggcuugccgcagaaaacccugugaaagagcaucgcgacucuaagccauaccaguuggacgaacugcucaauuucagaauccccuauuacgugggcccuaugauuaccaaaaagcagcaagagaaguccggucagaacgucuuugccuggaugguuaggaaagauccaagcgggaacaucacacccuacaauuucgacgaaaagguggaucgugaggcuucggccaacgcauuuauacagcggaugaaaacgacugacacauaucugauuggagaggauguacuuccgaagcagucucuguuguaccaaaaauaugaagugcucaaugagcugaacaauguccgagugaacggcgaauccuuaucaaccgaccagaagaaaagacugaucagggagcuauucgagcgccacaguagcguuacucucaagcaguucguggaaaaucuggucgcgcauggcgauguggcuaagcggccugacguaagagggcuugccgaugagaaaagguuuuuguccucucugagcacauaccaccagcuccgcggaauccugcaugacgcaauugaugaccgagguaagcaaucagauaucgaaaacauuauaaccuggaguacgguuuucgaggacgccuccaucuuuaaaagcaaguuaggcgaaauuucuuggcuggacucaaaaacccggacaacucuuaguaauauccguuauagaggguggggacaguucagcaggaaguugcucgauggccugaagcuagguaacgggcacaccaucauucaggagcugaugcucuccucucgcaaucugaugcaaauacuuacagacgagacuuugaaaaaggaaauggcuacccugaaccaggagcgguuaaaacccgauucgaucaaugaagccauugacgcagcuuacacaagcccauccaacaagaaagccaucagacaggugcucaaggucguggaugacauuaagcacgcggccaaugaucaggcuccuucauggcuguauaucgagaccgcagacggcggaggccaucccgggaaaaggacucuuagucgacaaaagcagauacaggccaucuacgaaaacacggcuaaagagcugauugauucugccguccgcggagaguugaaggacaaaaucgcagauaagacaaacuuuagcgaccggcucgugcuguacuucaugcaggguggccacgacauuuauaccgggacugcgcuaaauaucgaucaacuguccucauacgacauagaucauauucucccacagagccugaucaaggacgauucucuugacaacagaguuuuggugcacgccaaaauuaauagggaaaagaacgcugaguuugccuccacccuguucgcagcuaaaauggccaguacauggcaccguuggcgcgaugcaggauuaaucagcggccggaagcucaaaaaucugcuuaugagacccgacgaaguagauaaguaugccaaagguuuugucgcuaggcagcugguggagacccgacagauaaucaagcuaacugaacaaauuguugcggcccaguacccugacacaaagaucauugcagugaaagcugggcucucucaucagcugcggcaagaguuggauuucccaaagaaccgcgacgucaaucacuaucaucacgccuuugaugccuuccuggcugcaagaaucggcacguacuuacucaaaagguauccgaaccuggcccccuuuuucaccuacggagaguucacuaagacaaaucuuaaaaagcugcaguccuuuaacuucauaggcgcguugacccauacagacgggaagauuacuucaaaagacaccggagaagugcucugggauaaucagcgggacaucgaggaacuggaucagaucuacaacuuuaagcgaaugcuaauuacgcacgagguauauuucgagaccgcuggucuguuuaaacaaacaguguacgccgcaaaggacaguaaagaaagaggcgggagccgccagcuuaucccuaagaagaaaggauauucgacuggcauuuacgguggguauacccaggagacaggcuccuacaaugcccucguuaggcugacuaaggcuggaaaagucguguaucguguguucaagauaucuacccagaacgcagccgaaaucgcggcugcccggagcuugucagcagaggaaggcaaugagagacugugucaaauuuuagagcagagucuccugaaaacgaacaaggauaagaaaaacacagucgaccuuuuugauguugugaucccaaggcuggggaaggaagccuuguuccacaauuccaaauacggacucuuucuggugaacucugacaccuacuaucauaauuaccaggagcuauggcugagccgcgaaaaccagaagauucuuaaaaagcucuuuuccacuaaguaugaucaaucagagauggaccgagaugcucugcacuuguuugaaacaaucgccaaacagguagagcaguucuucaaguuauacgacauaaaucaguuuagaaccaaaaucagcagugcauucgaugcuuuugagaagcugcccgucgaaggcgaggaagguaaaguggagacucucaagcaacugcuuauugggcugcaugccaacccuguucggucugacuugaaaaaucuaggaaucaagaccccauucggcuuucugcaggcggguaagggcauucaccucgacgaugacacagaaaucauacagcaaucccccgccgggcuguucaaaaggcgcgugcgucuugcagauuuauga

SEQ ID NO: 3061 - RNA, 4086 nt, Artificial Sequence
  Cas9 variant
augaccaagcugggcaaacccuacgggaucggaguggacauugguagcaacuccauaggcuucgccgcugucgaugaaaauucucaccucaucagacuuaaggggaaaacaguuauuggagcaaggcuguuugaagagggcaaggccgcggcugaccggcgcgccucacgaacuacgcguagaagguugagucggaaccgcuggagacugagcuuccugagggacuuuuucgaaucccauaucaccccuacagguccaaacuuuuucaugcggcagaaauauucugagauuucgccgaaggauaaggcacgcuacaaauaugaaaagcgacuauuuaaugauagaacugacgccgaguucuaccaacaguaucccaccauguaccaccucaggaaucggcugcuuacagauccuucaaaagcugacgugcgugagaucuauuuugcaauacaucacaucuuaaagagccgcgggcauuucuugaccaguggauacgccaaagauuuuaacacuaauaagguagcucucaacgaaauuuucccagcccugcaggacgcguacgcacagguguaucccgaucuggacaucacauuugaugagaauaaggucaacgaguucaaaaccgugcucuuaaaugagaaggccacgccuuccgacacucaaagagcucugguuaaccuuuugcuggccgaggacggcgauaaagacauucuaaagcagcagaaacaggugcucaccgaguucgcaaaggcugucgugggccugaaaacaaaacuuaauguagcccuggggacugagguugauucuagcgaagcgaccguguggaacuuuuccuugggacaacucgacgauaagugggccgguaucgagucagcaaugacagacgaaggcaccgagauacuggaucagauuagggacuuauaccgggcucgacugcucaaugggaucgucccagccggaaaaacgcuuagucaggcuaagguggaugacuaugcccagcaccacgaggaucuggaauuguucaaagacuaccuaaagcaacuggaggacgauggcacugcaaaagccauucgccagcucuaugacagauacaucgauggugacgaugcuaagcccuuugugagggaagacuucgucaaggcgcugacaaaagagguuaccgcacauccuaacgccaagagcccagaacuucuggagcgguuggcucagccggauuuuaugcucaaacaacgcaacaaggccaauggggcaauccccgugcagaugcagcagagagagcuggaccaaauuauaaagaaccagucuguauauuacgauugguuagccgcuccuaauccaguggaaaagcacaggaaguccaugcccuaccagcuggacgagcuacucaacuuccguaucccuuauuacgucggaccacuggugacugccaaagaacagaaggcagcgcaaggcggcguuuuugcuuggauggugcggaaagaucccgacgggaauauuacaccguauaacuucgaugagaaggucgaccgagaagccucagcaaauaccuuuauccagagaaugaaaacgaccgacacauaccuuauaggagaggauguguugccuaagcagagccugcucuaucagagguacgagguacugaacgaacuuaauaacguucgcgugaauaacgagaagcugaguauugaacaaaaacagcaggucauccgggaguuguucgagagacauaauucugugacuaucaagcaguuugccgaaaaccucagggcucacggugacuaugcccacauucccgagauccgcggccuggcagaugaaaaacgauucuuauccagccugucgaccuaccggcaacuaaagucucuccugccagacgcuauugaugacccugccaaacaggcggauauagagaauaucauugccugguccacagucuuugaagacgcugcaaucuucaagacuaaacuuaaggagaucaacugguuggauucacagaccauuacaaagcugaguaacauacguuacagaggguggggacaauucagccauaaauuucucaauggccugaccuuagguaacgggcacacuaucauucaggagcuguuccuuuccaauaacaauuugaugcagauccucacggacgaaacacugcagaagaaaaugaccgagcuaaacgccgauaagcugaaagcugccaauauuaacgacgcaaucgaugacgcguauacuucucccagcaauaagaaggcccucaggcaagugcugcgcguuauagaagacaucaaacgggcugccgauggccaggacccaucauggcuuuacguggagaccgcagauggaggcgggacacccggaaagagaaccagggcucgacagcaucaguugcaagaaauuuaugccaacgcagcccacgagcugaucgacagugcuguacgcggugaguuagaagauaaaauugcggacaaggccgauuuuaaugaccggcucguccuguacuucaugcagggcgggagagauaucuauacuggaacaccucuuaacauagaccagcuguccagcuacgauauugaccauaucuugccacagucucucauuaaagacaauucacuggauaacagggugcuaguucacgcaaucauaaaucgugagaagaacgcuacguuugccaguaccaucuaugcccaaaagaugaacgcuacuuggcgccaguggcacgaagcaggccugauuagcggucggaaacucagaaaucugcagaugaggccggaccaaaucgauaaguacgccuccggguucguggcgcgacagcuugucgagacacggcagauuaucaaauugaccgaacagauaguggcugcccaauaccccgagacaaagauuaucgcaguaaaagccggccugucucaucaguuacgcgaggaacucgaguuuccuaagaacagagacgugaaucacuaucaucacgcuuucgaugcauuucuggccgcgaggaucggaacuuaccuucugaagcgguucccaaaccuacaggccuuuuucaccuauggcaaauuuaagaaagcugacguuaagaaacuccgaggguucaauuucauuagagauaucacgcacgcagaagacaagauugucgugaaagauaccggagaggugauaugggacaagaagcgcgaugucgacgagcuggauaggaucuacaacuuuaaacguauguugauuacacaugaaguucacuucgagaaggccgaccuguuuaaacagacuguguauggugcuaaggacucgaaagaagccggcgggaagaagcaauuaaucagcaaaaagaaaggauaccccguggauauuuauggcgguuacacccaggagacaggguccuaccucucaguaguccggcugacuaagaaagcaauguaugcugugguuaaggugaguaccagagacgccgcgaaacuugccgucgcaaaaucuaucagcgaacagaaggagaaugagacgcugaacgauauaaucgacgaaaaauuguccaagauuucaaagaauggcaagaucacacaugaacucuucgaagugguucugccuagggugggacagaagacccuauuuaaaaacagcaaguacaaucuguuccuuguaaacucugauacuuauaugcacaauuaccaagagcucuggaugccacgcgaauaucagaaaauguggaaggacauuucccugaguaaauacggcgaugcucagacagaggaccaguuggaucaaaucuuuggguucauagucagccaggugaacucuuauuuuaaucuguacgacauuaaccaguuccgaaagaaguuaaacgaugccgcugacaaauuugcaacccuccccaugagagauacugacgacaugcaaggaaagaucgccaccaucggccagcugcuuauuggucugcaggccaaugcugcgcgguccgauuugaggaaccucgacauaaaaacaccgcuggggcuacugcagaucccuaauggaauuucacuugauagugacacgagcguggucuaccaaucgccaaccggccuccuggagcgcgaaguucauuuguccgauuuauga

SEQ ID NO: 3062 - RNA, 4086 nt, Artificial Sequence
  Cas9 variant
augaagaaacccuacagcaucggccuggacauugggaccaacuccgugggauggucugucguuacagaugacuauaaggugccugccaaaaagaugaaaguacucgguaauacugauaaggaguacauaaagaaaaaccuuaucggcgcucuguuguucgacucaggggaaacggcagaggccaccagaaugaagaggacagcgcggcgccgauauacucguagaaggaaucggauuuuauaccugcaggauaucuuuaguccagaacuaaaccaaguggacgagagcuuccuccaccgccuggaugacuccuuucuugucgcugaagauaaaagaggagagaggcaugugauuuucggcaauaucgccgacgagguuaaguaucacaaagaauuuccgaccauauaccaucugcggaagcacuuggcagauucuucggagaaggccgaccuccgccugguguaucuggcucucgcacauaucauuaaauaccgaggucacuucuuaaucgaugaacccauugacaucagaaacaugaacucacagaaucuguuuaaggaguuccuuuuggccuuugacgggauacaggucgauugcuaccuggcuagcaaacacacagacauuaguggaaucauuaccgccaagaucuccaaaucuaggaagguggaggcgguacuagaacaguucccugaucaaaagaagaauagcuuuuucggcaacaugguuucccucguguuuggccugaugccaaauuucaagucaaacuucgagcuugacgaagaugcaaaacugcaguuuagucgggacagcuaugaugaggacuuggaaaaucuccuggggaucauuggagaugaguacgccgacgucuucguggcugccaagaaaguguaugauucuauauuacuguccgguauccucacuacaaacaaucauucaaccaaggcaccccuuagcgcuaguaugauugaccguuacgacgagcacaacucugauaaaaagcuguugcgcgacuuuaucagaacgaacauaggcaaggaagucuucaaagagguguuuuaugauacuuccaagaauggguacgccggauauauugacggcaaaaccaaccaggaagauuucuacaaguaccuaaagaaucugcuccagaagguugacgguggggauuauuuuaucgagaagaucgaaagggaggacuuccugcggaaacaacgaacauuugauaacggaagcauuccucaucagguacaccuugacgagaugaaggcgauccugcgcagacagggcgaguucuacccauuuuugaaagaaaaugccgaaaagauucagcaaauacucacuuucaaaauccccuauuacgugggcccucuggcaagggggaacucgcgguuugcuugggccucuuauaauuccaacgagaagaugaccccauggaauuucgauaacgucauugacaagacaucaagugcucaggccuucaucgaacgcaugaccaauaacgauuuauaccugccggaccagaaagugcuacccaagcacagccuccuguaucaaaaauuugcaguuuacaaugagcuuacgaagaucaaauacgugacugagacaggagaagccagauuguucgacgucuuucugaagaaagagauuuucgauggucucuuuaagaaggaaaggaaagugaccaagaaaaagauacugaacuuccuugacaaaaauuuugaugaguuccguaucacugacauucagggccuggauaacgagacagggaacuuuaaugcuuccuauggaaccuaccaugacuugcucaagaucauuggcgauaaggaguucauggacucuagcgauaacguagacguucuggaagauaucguguuaucacugacgcuauuugaagaccgggagaugauaaaacagcgacuccugaaguaugaagauaucuucaguaaaaaggucauugcgaaucuuaccagaaggcacuacacagguugggggcgcuuguccgcaaaacugaucaacggcauuaaggacaagcauagccggaaaacuauccucgacuaucugauagaugacggacacucuaauagaaacuuuaugcaguuaauuaaugaugacaaccugucauucaaggaugagaucgccaauagucaagugauuggcgacggggaugaccuucaucaggucgugcaggaguuggcuggaagcccugccaucaaaaaggguauacuccagucccugaaaaucguugaugagcuagugaagguaaugggcuacaacccagaacaaauugucguggaaauggcaagggagaaucagaccacagcccgcgggcgaaacaauucucagcagcggcugggaucgcucacuaaggcuauccaagacuucggcagcgauauucugaaacguuaucccguugaaaacaaucagcuucagaacgaccaguuguaccuguacuauuuacaaaacgguaaggacauguacaccggggauacacucgacauccacaaucugucccaguaugauauagaccacauuaucccucagucauuuaucaaagauaacagucuugacaauagagugcugaccaacucuaagagcaauaggggcaaauccgauaacgucccaucaaaugaggugguaaagcgcaugaaaggauucugguugaagcaacucgacgccaagcugauuagccagcggaaauuugauaaccuaacuaaggcagagagaggcgggcugucugcggaagacaaagcuggauucaucaagaggcagcucguggagacgcgacagauuacaaaacauguugcccgcauacuggaugaacgguuuaauagagacuucgauaagaacgacaagaggauccguaaugucaaaauugugacccuuaaguccaacuuggugaguaauuuucgcaaagaguucgguuuuuacaagguccgggaaaucaacaauuuccaccaugcacacgacgccuaucugaacgcuguuguggccaaagcauuacucauuagauaccccaagcuggagccggaguuuguguauggcgaauacccuaaguacaacagcuauagggagcgaaaaucugcuacugaaaagauguucuucuacuccaauaucaugaacauguuuaaaaccacaauaaaacuugccgaugggcggguagucgagaaacccgugaucgaggcgaaugaagagaccggagaaauugccugggacaagacuaagcacuucgcuaacguuaaaaaggugcugucauauccacaagucaguaucgugaaaaagguugaggaacagacaggcgguuuuagcaaagagucgauucuaccuaaagggggcuccgauaagcucaucgcacgcaaaacgaagaauaacuaccugucuacccagaaauauggaggcuucgacagccccacuguggccuacucaauaauguuuguagcugauauugagaaggggaaaaguaagagauugaaaacagucaaggaaaugaucggaaucaccauuauggagaggucccgguucgaaucuaauagcgugacauuucuggaggaaaagggcuaucgaaacauaagagagaauacuaucauuaaauucccaaaguacuccuuauuugagcucgaaaacggucgcaggcgucugcuugccucagcaaucgagcugcagaaagggaaugaaauguucuugccccaacaguuugugaaccuccuguaccaugcgcagcacgccaauaaggaggacagcgucauuuaucuagaaaaacaucggcacgagcugagugagcuuuuccaucacaucauaggaguuucugaaaagaccauccucaagccuaaaguggagaugacgcugaacgaggcuuuugaaaagcacuucgaguucgaugaaguauccgaguuggcccagagcuuuauuucgcuguuaaaauucaccgcauuuggcgcuccagguggcuucaaguuucucgacgccgauaucaaacaaucaaaucugagauaccagacagugacugaaguccuuucuaguacccugauucaucaguccgugacaggguuguaugagacuaggaucgaccucagcaagcugggaggcgaauga

SEQ ID NO: 3063 - RNA, 4086 nt, Artificial Sequence
  Cas9 variant
augggcaacuacuaucuggggcucgacaucggaaccaauagcguggguugggccgucacagaugagaacuacaauauugaaagauucaagaaaaagaacauguggggcauaaggcuuuuugacgaggcuaaaacugcagaaucccggcgcauccaccgacaggcccguagaaugaggcaacggaagauucagcgccugaauuuguuaauggagcuguucgauguugaaaucucuaaaguggacgagucauuuuucauuagaaagaaggagagugaucuacauuaugaagacaaaagccaggauuccagguacgcgcucuuuaacgacaaggaguucaaugauaaagacuaucacaacaaguaccccacgaucuuucaucugauaauggaucuuaucgaaaaugacgagaaaaaggauauucggcuguuguaucucgcuugccacuaccugaucaagaaccgcgggcauuucauuuuugagggacagaaauucgacguaaauucuucgcugaacaauaacaucaauaagcucaaaucacacuuagaccaauuuuacaacauaugucuggauuucgacaacgauaaacuuauugaaaucuuggugaaucagaaccugaauauuagcgagaaaaguaagaaaaucaaggaacuacuccgaaagaccaaccuggaggucggcaucgccaaucuuauugccgguggguccauaaaacugucuaacauguuugacgaugacgaauugaagaaucucgauuauaacagccuguccuucaaaaauucaaacuucgacgagggaagagaguuauuugaagaggugcuggaagauagguucgagcucguugaaauccuuaaggacauucacgaugcaagugugcuggagacaauguugagcucugcuuccaucucaccugacggcggcaaauacauaagcaguucuaugauuaauuccuauaacaagcauaagcgggaccuaaaacugcucaagaaaaucaucaagaaauacaaaaagagcgaguaugauaauauuuuucgugacgaaaacaucaaaaauaacuaccugucguauacucgcaccgggauuaacaagaauaaaaagguccaggcagaggauaacacagacucugauggauucuacaaauacauagugaagauccuuaaggacauuaaagaaaaugauuccgacgaggauaucaaguauauccugucagaaauugacaaaaagaacuuuguaccaaaacagagaaccaaggagaauaguguuauaccguaccaauugagggagaucgaacuccggaaaauuaucgauaaccagagcaaguaucacaaguuccugaaugagguggacgaaaaagguauuuccgucaaggagaaaaucauaucuuuacugacuuuucgaauccccuacuauauuggcccucuaaacccaagcuacaaugaggaaaagaacuucacaaccucaugggugaaacgccucgccaaggggaaggugacgcccuggaauuuugaggauauggucgacaucgacgcuaguagagaagccuucauugagaacaaacugaauaagugcuccuuucuuuuggaugaaacuguucugccuaaagacagccuccuguaucaggaguacauggugcuuaacgagcugaauaacuugaagaucaacggacagucuauaaauaccgaucucaaaaagucaauuuacgaagaacuguucaagaaauauaagaaaguaacaaggaagcgguuaaucaguuacauuaaagaaaaggagaacaugagcggcgacaucgugauaacugguaucgauggggacuuuaagcaaggacugaaauccuauauugcguucaaggauaucauuggcgaaaagaucgacgaugacauauaccgcaaggaggucgagaaaauuaucagagauaucucucuauauggcgacgauaagucguucauucagaaaaagaucaagaaugaaaacaaacucgaccugagcgacgaucagauuuccaagauagcaaaacuuaaguuuaaagacugggggagguucucaaagaaguugcuggugggaaucaaagccagugauaagaauaccggugagauugacaacaucauuggcuuuaugcguaauuacaacuauaauaucaugcaacucauggcuaacguuuucacauuuaaagaugaaauagagaagcugaauaguaaauacuacaccgacgaaaagaucaacauugauuauuuagacgaucuguaccuuagcuccccagccaagcggauguuguggcagucauuccagaucguggacgagauuaaaaauaucaagaacagcgaucccaaaaagauauuuauugagauggcacgaucuaaagaagacaagccuacgagaaagauguccaggaaaagucgccucgagaagcuguauacugacagcaaaaagcaguucaucaaacuauuugggccagaugaauacgacaagcugaauaacgagaucaagaacaaaucugaguccgauuuccggugggacaaucucuaucuguacuauacacaauuuggaagauguauguacucacuugauccgauugacuuggaggagcugaguaacaagaauuuauacgaucaggaccauauauaucccaaaagcaagaucuacgaugacucgauugaaaacaggguccucgugaaaaagcagcugaaucuugauaaauccaacgaguauccuaucccagaccgcguacugaauaaggauaagaacaaauugcucgcuuucuggaagaugcugaaugaaaaagagcuaauuggcgacaagaaauacgcccgacugauccggaagucucccuuuaccgacgaggaacucggugauuucauagcgcgucagcugguugagacuagacaagccacaaaggaaaccgcaaacaugcuuaaaagguugugcccugacagcaagaucguguaugucaaagcuaagaaugugucagauuuccgccggaaauuugacauucugaaguguagaaguaucaacgauuuacaccacgcccaugacgcuuaccucaauauugucguggggaacguuuucgauacgaaguuuaccuccaauccacugaacuucaucaaaaauaacucuaagaacaggagcuauaaucuugagaaaauauacgacuacgaugugauucgaaacgaaaagaucgccuggcuggcagagcgcaaagaggaaaaucaggacggcuccaucgccacaguacuaaagaaccucucaaagaaugauauucgggucacuagaaggaccuauaucaaaugcgaggaccuguuugaugaaaacauagugcguaagggaaauggcaaauuccccauuaaggagaacaauaacaaaagcgacacaaauaaguacgggggauauagugguaucaaaaacgcuuacuuuguuuugcuggaagacgagaagcacaaucgcauuuuagaggcgaucccgucuuucauauauaagaaagaaaagaacggcgagaaaggguccgugauuaauuaccuccagaacauccugggaaucaagagcgcaaaaauucuucgggauaagaucaagauuggcucgcuguugaaaauagacaaguuuccuuauaaccucgccgguaaaucagggaauggcauccugauuucuggaggcguccagcuaauccuggauaagaacacuucuaaauacaucaagaagauugaaaauuacaaauauaaacuugacgagaacaaggauuaccaaauaaauaucuucgacaagcucuccaaagaggaaaacauuaagcuguuugauuuguucguggacaaguucgagaauagcaucuauaaaaacagaguaaauauuaagcugaaagaaaucaaguuagcuaggcccaaauuugagcaucucucuauagaggaacagaucaagacccugacacagaugcuuauucuguucgggcgagagaacaaugccgugaacuuggaauacaucggacucccaaagaauaccgguaagacuaagauuaacaaaaagaucaauaacaaagauauaaagauuaucaaccagagcauuacgggccuguaugagacagaagaggaccuagcaaauaucuga

SEQ ID NO: 3064 - RNA, 4086 nt, Artificial Sequence
  Cas9 variant
augaccaagcugaaccagcccuacggcaucgggcucgacauuggaagcaauuccauagguuucgccguggucgaugcuaacucucaccuucugagauugaaaggcgagacagcaaucggggccagguuauuucgggaaggacaaucagcggcugagcgccgagaaagucguacuacgagaaggcggcugagccgcaccagauggaggcuauccuuccuccgggacuuuuucgccccucauauuacaaagaucgauccagacuuuuuccugcgccagaaauauucugagauuucgccgaaggauaaagaccgauuuaaguacgaaaagagacuuuucaaugauaggacugacgcagaguuuuaugaggauuaccccucaauguaucaucugcgguugcaccucaugacccacacacauaaagccgacccucgugaaaucuuccuggcuauacaccacauccuaaagagccgcggccauuuucucaccccaggugcagccaaagauuucaacacugacaagguugauuuagaggacauuuuucccgcucugacagaagccuacgcacagguguauccugaccuugaguugaccuucgaucuggcgaaagccgacgauuucaaggcuaagcuacucgacgagcaggccacgccaagugauacucaaaaagcacugguaaaucuucuguuguccucugacggggaaaaggagaucgugaaaaagagaaaacagguccucaccgaauuugcuaaggccauuacaggacugaaaacuaaguucaacuuagcgcugggcaccgagguggaugaagccgacgcaagcaauuggcaguuuuccaugggccagcucgaugacaaguggucaaacaucgagacaaguaugaccgaucaagggacggagauauucgaacagauucaggagcuuuacagggcucggcuguugaauggaaucguucccgccgguaugagccuaucucaggcuaaaguggccgacuacggccaacacaaggaagaccuggagcucuuuaaaacuuaucugaagaaacuuaacgaucaugaacuggcaaagacaauucgaggguuguacgaccgcuauaucaauggagaugacgccaagccuuuccucagagaggauuuugucaaagcucugaccaaggaggugacugcgcacccaaacgaaguauccgagcaguuacugaauaggaugggccaggcaaacuucaugcuaaaacaacggacaaaggccaauggugcuaucccgguucagcuccagcagcgcgaacuggaccaaauuauagccaaccagucaaaauacuaugauuggcuugcaaagcccaacccuguggagaagcacagagccagcaaaccauaccaguuggacgaacugcucaccuuuaggauccccuauuacgucgggccucugauuacgccaaaggagcaggcugagagucgugaaaauguguucgccuggaugauccggaaagaucccucuggaaacauaaccccguacaauuuugacgagaagguggauugcccugcauccgcgaacauguucauucaacgaaugaaaaauacagacacuuaucuuaucggcgaagauguccugcccaagaggagcuugcucuaccagaaguaugagguucugaacgaguuaaauaacgugucgaucgacggcaggcgccugggggcugaccagaaacagcggcuaauuagagaaguauuugagaggcauucuuccgugaccaucaagcaagucgccgaaaaucucguggcacacggagauuucgccaaacgcccagagauucgaggucuggcugacgaaaagcgguuccuuucaaguuugagcacauaccaucagcugaaaaagauacuccacgaggccaucgaugacccuacuaaagagcaugauauugaaaacaucaucaccugguccacaguuuuugaggacgcagcuauuuucaagaccgaacuggccaagauaucuugguuagauagcgacacuaucaaagcgcugucaaauauucguuauagaggcugggggcaguuuaguaggaaacuuuuggauggacucaaacugggcaacggucacacggugauccaggagcuaaugcuguccaaucacaaccucaugcaaauucugacagacgaaacccuuaagacuaccauggccgaguugaaucaggauaaacugaaggcugacgauaucgaggacgucauaaacgacgcauacacaagccccucuaacaagaaagccuuacgccaggugcuccggguaguugaagauaucaagcaugcugccaaugggcaagacccaucauggcuguauauugagaccgcagauggccccggaacugcgggcaaaagaacacagaguaggcagaagcagauccaaacgguguacgccaacgcugcccaggaacuuauugacagcgcaguccgaggggagcuggaagauaaaaucgcugacaaggccuccuucaccgaucgcuuggugcucuacuuuaugcagggaggucgggacauauauacuggcgcaccucugaauauugaucagcuaucucacuacgacaucgaucauauucugccacaaucgcucaucaaggacgacagccuggauaacagaguccuugugaaugccacaauaaacagggagaaaaauaacguuuucgcuuccaccuuguuugcgucaaagauggccgcaacauggcguaaauggcacgaggcugggcugaucaguggacgcaaguuacggaaucucaugcugagaccggacgaaauugauaaauucgcccacggcuuuguggccaggcagcuuguagagacucgacagaucauuaagcugaccgaacagaucgcugcagcccaauaucccaacacgaagauaauugcggucaaagcuggucuaucucaucagcuccgggaggagcuggacuucccuaagaaucgcgaugugaaccacuaccaucacgccuuugacgcauucuuggccgcuagaaucgggaccuaucuguuaaaaagguacccaaagcucgcacccuuuuucacauauggcgaauuugccaaaguugaugugaagaaauuucgggaguucaauuuuaucggagcgcugacucaugcuaagaagaacauugucgccaaagacaccggcgaaaucgugugggauaaggagcgagacauucaggaacuugauagaauauacaauuucaaacgcaugcugaucacacacgagguauacuuugagacugcagacuuguucaagcaaaccauuuaugccgcuaaagauagcaaggaaagagggggauccaagcagcucaucccuaaaaagcaggguuacccaacacagguguauggcggguacacgcgugagaacaccgccuaucuggcaguugucaaaacuguggaaaagaaagcugacguguaccgggucguuagaauugccacaucacaaguggcggcccuaaaggaggcaagggcucagagcaccgugaaggaacgcgagcugcuuaaaaaguuucucacuaccaaauucacaaagaucggaaagaacggcaagaaggccauaacgcccuuugacaucguaauuccgcgagucccuagagagcagcuguuccacaauaaacgguaugguuucuucauggugaacucugauaccuugaugcauaauuaccaggaacuguggauguccaggagugaccaacagaucuuaagcaagcucguuaaaucugcuaagacuguggagaacgggcaggucggccgccuguucgaaaauauuguggagcagaucaacaaauacuuuccacuuuaugauauaaaucaauuccguaagaagcuggaccaguccaaagauaucuuuucaaaguugccccucgaaggaaacggcacaaccagugggaaaagagagacaauucagaauauccugacuggagcaggcaccggugccaagaacggggaccugaaaaaucugggaauuaagacgccuuucggcuuucuucagguucccagcgguauagugcucgaugacgauacaacccugaucuaccaaucgccaacuggcauguugaaccggauuguaagguuauccgagcuguga

SEQ ID NO: 3065 - RNA, 4086 nt, Artificial Sequence
  Cas9 variant
augaagaacgaggaaaauaucuaccugggccucgacauugggaccgauagcgugggauaugccgucacagacgauaaauacaagauaaugaaauaucacgguaacgcugcauggggcuccacuaucuucgacgccggggcgcuuggagcugauagaaggguuuuucggucugcccgccgacgucuggacagaaggcaggagcggauucaauuguuacaggaaaucuucgcaaaugagauugccaagguggaugaacgcuuuuucaucagacugcuagagucaggccucuggagggcugacgcagaggaucgguacguauuuuucaacgacaaagaauauacggaugugcaguacaugcgcgacuaucccaccauacaucaccugaucugcgagcuuauuuacaauccuaacaagcaugauguccgacugguguacuuggccugugcuuggcucguuacacacagaggucauuuucugaguaauaucaacacugaaaauauugccgaccugguggacauccacaacgucuauaauggguucaugagguuuuucgaggagaacgaaauaauuugcgauuggcgggaggugaauguagaggaacucggacguguuuuagcggcaaacaucggcauuaaugaaaaguaccgcaaccugagcaccgugcuuuuugccacaagaaaaccagacaagaaagcuaaggagggcuucccguauuccgaggaugccaucgucagguugcuggcagggggaaccuguaaacuaaaggacguguacaucaaggaagaguaugaugaauuugguucuauuacucucggcauggacgaugagaaaaugacagaaauaauggcugacaucggggaugacuucgaucugauuaaggcccuucggucgcuguacgacuggggaaucuuggcgaacauacucgugaaugagaacaauucaccccugauuagccagaguaaagucaagguuuaugagcaacaccgagaagacuuagccaaccugaaauaccucgugcauaaguacaucccucacaaauauaaugagaucuuccgcgaaauuagaggcgauaacuacguagcauauuccuaccauuaugagcuuaagaaugacgaaaagauggguaaaaaggcugauguggagaaauuuucuaaguuccuguugaaaauccuagaggggauuagcgucgacgaacaggauaaggugguuuacgacaacaugauagagaggcugacccuccggcuguuucuuccaaagcagaaaaauacggauaaccgcgugaucccccaccagcuguaugaauacgaguugaaguccauucucaaaaauacuaagaacuaccugccuuucuuaaaagagaaggacucagauggaaucaguaaugaagacaagaucauuagcauauuuaaauucaagaucccauauuuugucggcccccugaacugcaauucucaauucgccuggauucagagaaaagcugauggcaagaucuuuccuuggaacuucgaggacaaaguggauuuugacgccuccgaacaggcauucauucagaggaugaccaaccaauguacauaccuaccagaggaaucaguacucccgaagcagagccuguauuaccagaaguuuaugguucuuaaugagaucaacaauauaaaaaucgacgggcguaagauuaguguggccaugaaacaagaguuguauaacgaaaucuucgagaagaaaaagcggguccgaaagaaggaugugauugacuucuuugucucuaauggauaccuggaagguggcaaggaggcucucaucuccgggcuggaugaacagauacacacuaaccuuagcucguuccaugcguuuagaaggcuguugcagaaucacauucucucuguggaggacguugaguccaucauugaacgcgcaucauauagugaugacaaacggagagugcuguuauuccugaagaacaaauacagcuuucuaaccgaugaggacaucaaguacauaugcaaaaucaagauuaaggauuucggaaggcucuccaaaaaguuucugguagacuucgaaggcacauguaaagagaccggugaaaucucuacgguccuucgcuugaugugggagacuaauaacaaucugauggagcuccugagcgauaaguauacauuugccaacgggauuaaagaaaaucgaaagaaguacuauaccgagcagcaaaagacuuuagacgaucggcuggacgaaauguacaucucaaacagugugaagcguacaauauauagaacccuuuccguugugaaagacgucacgaaggcuuucggcgugcccaaaaagauuuuuguagagauggccaggaccaauaacccugauuugaagggaaaacgcacacggacuagacagcaacaggugaucgagcucuacgcaaagugcgacgaagaggauguuagggaacugaaacaucaaauggagagccuaggcgaauaugucgacaacaagcugcagucugauaaacucuuccuguacuuuauccaguucgggaagucagccuacaguggaaaaaugauugaccuugagaaguugaugagcgguuccaagguguaugauaucgagcacauuuacccacaggcuuaugugaaagacgauucuauaaucaauaacaagguccugguuuucucggaagagaauggcgccaaacaagacauuuaccccaucaagaccgaaauucgaaaacagaugagcgggaucuggacaacuuggcaucacgugggagcaauauccgaugagaaguauaagcgcuuaacccggucaacaccuuuuaacgaagacgagaaauacggcuucaucaauagacagcucaccgagacuucccagucuacgaaggcgauugcucaaauccugaacgaaaaauauccagagacagaaauuguguacguaaaggccggucuugucagcgacuuuaggcacgaguucgggcuguguaaaugccguuccuacaaugauuugcaucacgcaaucgacgccuaucucaacgugguugugggcaaugucuacaacaugaaguuuaaucgcaagugguucucaguggauagcaaauauucuauaaagaccaaaacuauuuuuagucauagucugguuuguaacggaaagaucaucugggacaaagaaaagaugcuacccauggugcugaagaaugcuaaaaagaacaaugcccacuucaccaaauaccaguuuaugaagacaggcggguucuuugaucagaugccgugcaaaaaggcaagcggacucguaccucggaagaaaggucuggacaccgagagauauggcggguacaacaagucuggaauuauguuccuuacucccaugagguauaaaauaggcaagaaauccgauaucauuaucuugucaauugagcuguuauacgguaaacucuuccugaaagacgaagucuuugcuaagaaguacgccgaggaacgacuucagaaaaucauagggaagaaagcggaugaggugaguuucccaaugggcaugaagccuuggaaaaucaacacagugcugagccuagacggauuuaaugucugcauuacgggcaucgggggaggcgguaagugucucucggcccagcccauuaugcagcuguccuugccauaugagcuggcuaaguaccucaaaaagaucgaaaaauucguugagaagaacaaaaauaacgcaaauuauauauacgaugaacaguaugacucugugagcguagaugagaacauuaaguuauacgacguguaucuggacaaacuugaaaauucaaucuacaacaaacggaucaauagucccgaggccauucugaagaacgggcgcgagaaauuuugcaaguugaauguccucgaacaagcugugacccugaucaacauacaguccauuuucggaagaaugacuggcgguugugaucuagagaauaucggcgggaaaaagcacucugccgcaacaguuaacuuuagcuccaaugugucaaacuggaagaaauacuauaaugacgucagggugguuuaccagagcccuaguggaauuugggaacggcgaucucagaacauccuggagcuucucuga

SEQ ID NO: 3066 - RNA, 4086 nt, Artificial Sequence
  Cas9 variant
augaacgagcccuacggcguggggcuggacaucggaaccaauagcgucgguuggacaguuguggauaugaacggcagaguaaggaaggugaaagggaagacugcccucggagcucggcuuuucaaagaaggcgcaacggccgaggaccgccgagguuuucguaccacaagaaggcggcugaagcgcgucaaauggagauugagguuacugcgggaguucuuugaucagccuauuuccaagauagacccaaauuucuuugcgcgccgaaaguauucugauaucucaccgagagaccccaacuacaaugggcuagcuaaaacucucuucaacgauaggaccgacaaggaauuuuaugaugacuacgccacaauuuaucaucugcgggauaaacuuaugaccaguaaucguaaguucgacauccgcgaaauuuaccuggcaauccaccacauagugaaauauagaggaaacuuuuugaggacuggcccugccagccaauacggcuccgcuucucuccaucuggcaacaucguuccagaagcugaaugaucucuuugcccagucagaggagaccuuaaaccugaaacuuguuacggacgaagcucuacugcagcaaauccagcagauucuagugcggacugaccucagccgaagugagcagcaacgccagaucuggccacugauggccguccuuaccggggcguccgcagccgaaaagaagagacagaaaaaugugguaguugagcugucuaaggcuuuggugggacucaaagccaagaugaacgucgugacacugacugagguggaugcagcugucguuaaagacuggaccuucacaauggaagagagccaggauaaguuacccgaaauugaggaacaacuguccgaggugggucagcagaucauggacgagguaauacaacucuacgccucagugaaucuugcgcagcugauuccugccggcaagagguuuagucagcacauggucgaaaaauauaagcaucacgagaaaaacuuggaacuacugaaggcauacauccacagccagucugauuccaaacgggggcgcgagauuagagcuaccuaugacagguacaucgauggaguggacucaaagccaguuacgcaagaaauguucuauaaggaucucaugaaauacguggaggccgacgcuacuagcaaucaucuggccgcagagaucaaggaugaaauugacagugagcaguucaugcccaaacuucguacaaagcagaacggcucuauaccuuaucagguccaacaguacgaacuggaccagaucauuucccaccagaaaaaguacuauccaugguugggugaggaaaacccgguggccgagcggcgagggaaguuucccuacaaacucgaugagcugguaggauucagaguuccuuauuacgugggcccauuaaucaccaaggaagaccaacaggcuacuagcggcgcgggguuugcauggauggucaggaaagccgauggacccauaacaccuuggaauuucgaccagaagguggaucgcauugcuucggccaccgcauuuauccagcggaugcaaacgaccgacacauaucugaucggugaggauguccuaccagccagaucucucauuuaccagagguucauggugcugaacgaacuuaauaacaugcgcguugaggaccgaaaauuggcuccccagcaaaagcagcggcuguauaaucagguguuuaagcagcaucaacacguauccgucaaaaacauccagcagaaucucauggaugccggcgaguaccguaagacuccgcagauuaccgggcuggcagacccuaaaggauucaacucaagucuuagcacauaccacgauuuuaagaaaauacuguuggaagcgaucgcugacgagcauaagagagccgauauugaaaagaucauccucugguccacuaccuucgaggacucugcaauuuuuaagcaaaagcuggaagagguggccugguuaacagacgcucagaggaaacagcugagcggccuacgcuaucgggguugggggcagcucucacacaagcugcuuaccgccuucaaagaugacaagggcagaaguauaauggauggauugugggagacuuccgacaauuuuaugcaacugaggaaacagcccgcaaucgaaacgcagauuaaggaggcuaaccaagccaaucucacagaugcggacauccaggauaccauuaacgaacuguacacuagcccacagaauaagaaagccauccgagagguuauguuagugcuggacgauauaaagaacgcuaugcauggccagaccccuucuuggaucuucgucgaagcagcccgcgggggagguguggcuggccggagaacacaaucaaggaguagccagauuguagaggccuauaaagggaccgcaaaggagaucguguccgaaaaaguucagcacgagcuuaaugaaaagauuaaggcgaaagccgacuucaacacucguuugguccucuacuuucugcagaacggacgcgaucuauauacaaaugaggcuaucaacauagaccggcugucugaauacgauauugaccauauccucccccaaucgcuggugaaggacgauagccuugacaauagaguguugacguccgccaggauuaaccgagagaaaaaugauaccuucgcaucagagaaguuuggccggaaaaugggugcucaguggcgcgaacugcacagaaacggguuaaugacucagaggaagcucaagcaucugcuuaugcggccagacgagaucaguaaacacgccacagauuucauaaaucgacagcuggucgaaaccagacaaguuaucaaguugguggaggagcucauuucuagcgaauaucccgcagccuccaucguggcuguaaaagcgaaccugacacaccaguuucgccagacuuucaauuuuccuaagcuaagggaggucaacgacuaccaucacgccuucgaugcaucacugaccgcuuuuauuggcauguaccuccugaaacaguauccaaaacuugaacguuucuuuguguacggaaaauucgccaagcaaccgaucaauuugacgcgguuuaacauaauuagaaagcuggccguugcugagaaacccaucgcaaauaucgaaaccggcgagauuuuaugggacaagacagccgauaucaaauauuucgagaagcucuacaacuauaaaaggcugcuugugacucacgaaguccgcgagaauuacggggcgauguucaagcagacccuguuuaaggcuagcuauaacaaaucuaagacauuggugccuaaaaagaaccauauggaaacuuccguuuacggagguuacaguaaucaggagaccgccuaucucgcaauugugcgaauaccauucaaaagcggcuuuaaguucaucguagucgggauucccacgagaaugguggccaagaucaaacacuaccaaucucugggagcuacauugaaccaggcaacccauaaggugauugaaccuaaauuuacuaagaucucccggaaaacaaagcagaccgucauaucagacuaugagguugugcugccaaagguauacuuagaucagguggucagggaccaagugaaaggccagauguaucgcuucagucucgguagcgacaaggaguaccacaauguucaggaacuguaucuuccccugucgauccagcaagccuuuguggggcauuacgaugaguccgacgaucagcguucuaacgacuuggucaaaguguacgaugcggcucucaagcagcugcagagauauuucccgcuacaccugagccggaauuuugaccaaguugccucacaggcacaccagaguuucgaaggccuuaaaaacaaugugcaaacuuccgauaagcagcucggaaagaaagagguccugaacucuuuguuuguaggccugcaugccaaugcuaccaggagcaacuuauccgugcucgggaugucaaaggacuucggacgcauuaaaagcaauggcaucacacugacggaucaggccgaaauuaucuaccagaguccuaccggucuuuucgagcgaaagguugcacugaaagacuuguga

SEQ ID NO: 3067 - RNA, 4086 nt, Artificial Sequence
  Cas9 variant
augggcaacuacuaucuggggcucgacaucggaaccaauagcguggguugggccgucacagaugagaacuacaauauugaaagauucaagaaaaagaacauguggggcauaaggcuuuuugacgaggcuaaaacugcagaaucccggcgcauccaccgacaggcccguagaaugaggcaacggaagauucagcgccugaauuuguuaauggagcuguucgauguugaaaucucuaaaguggacgagucauuuuucauuagaaagaaggagagugaucuacauuaugaagacaaaagccaggauuccagguacgcgcucuuuaacgacaaggaguucaaugauaaagacuaucacaacaaguaccccacgaucuuucaucugauaauggaucuuaucgaaaaugacgagaaaaaggauauucggcuguuguaucucgcuugccacuaccugaucaagaaccgcgggcauuucauuuuugagggacagaaauucgacguaaauucuucgcugaacaauaacaucaauaagcucaaaucacacuuagaccaauuuuacaacauaugucuggauuucgacaacgauaaacuuauugaaaucuuggugaaucagaaccugaauauuagcgagaaaaguaagaaaaucaaggaacuacuccgaaagaccaaccuggaggucggcaucgccaaucuuauugccgguggguccauaaaacugucuaacauguuugacgaugacgaauugaagaauuucgauuauaacagccucuccuucaaaaauucaaacuuugacgagggaagagagcuguucgaagagguguuagaagauagguuugagcugguugaaauccucaaggacauucacgaugcaagugugcuugagacaaugcugagcucugcuuccaucucaccugacggcggcaaauacauaagcaguucuaugauuaauuccuauaacaagcauaagcgggacuugaaacuacugaagaaaaucaucaagaaauacaagaagagugaguaugauaauauuuuccgugacgaaaacaucaaaaauaacuaccucucguauacucgcaccgggauuaacaagaauaaaaagguccaggcaaaagauaacacagacucugauggauuuuacaaguacauagugaagauccugaaagacauuaaggagaaugauuccgacgaagauaucaaauauauccuuucagagauugacaagaaaaacuucguaccaaagcagagaaccaaagaaaauaguguuauaccguaccaacugagggagaucgaguugcggaagauuaucgauaaccagagcaaguaucacaaauuucucaaugaaguggacgagaaggguauuuccgucaaagaaaagaucauagcccuguuaacuuuccgaauccccuacuauauuggcccucugaacccaucuuacaaugaggagaaaaacuuuacaaccagcugggugaagcgccuagcuaaggggaaagugacgcccuggaauuucgaagauauggucgacaucgacgccucaagagaggcguuuauugaaaacaagcucaauaaaugcaguuuccugcuugaugagacuguuuugccuaaggacucccugcucuaucaggaauacauggugcugaacgagcuuaauaaccugaaaaucaacggacagagcauaaauaccgauuugaagaagucuauuuacgaggaacucuuuaaaaaguauaaaaagguaacaaggaaacggcugaucucauacauuaaggagaaggaaaacacuagcggcgacaucgugauaaccgguaucgauggggacuucaaacaaggauuaaagagcuauauugcauucaaagagaucauuggcgaaaagaucgauaaugacauauaccgcaaagaggucgagaagauuaucagagauaucucccuguauggcgacgauaaaucuuuuauucagaagaagaucaaaaacgaaaauaagcuagaccucucggauaaccagauuagcaaaauagccaagcugaaauucaaggacugggggagguuuuccaagaaacuuuuggugggaaucaaggcuucagacaaaaauacaggugagauugauaacaucauuggcuucaugcguaauuacaacuauaauaucaugcaacugauggccaacguuuuuaccuucaaggacgaaauagagaaacucaauaguaaguacuacacguaugaaaagaucaacguggauuaccuggacgauuuauaucugucugcaccagcuaaacggaugcuuuggcagagcuuucagauugucgacgagaucaagaauauuaaaaacuccgcccccaagaaaaucuucauagagauggcgcgaucaaaggaagauaagccuacuagaaaaaugagcaggaagucucgcuuggagaaacucuacacagacuccaagaaacaguuuauuaagcuguucgggccagaugaauaugacaagcuaaacaaugagaucaaaaacaagagugagagcgauuuucggugggacaaucuguaccucuauuacacccaauucggaagauguauguacucucuggacccgaucgaucuugaagaguuguccaacaaaaaucuguaugaccaggaucauauuuaccccaagucaaaaauauaugacgauaguaucgaaaacaggguguuaguaaagaaacagcucaaucuggacaagagcaacgaguacccuauuccagaucgcguucuuaauaaggacaaaaacaagcuguuggccuuuuggaaaaugcucaaugaaaaggagcugaucggcgauaaaaaguaugcacgacuaauucggaagucgcccuucacugacgaggaacugggugauuucaucgcucgucagcucguggagacaagacaagccaccaaagaaacggcuaacaugcugaggcgccuuugcccugacuccaagauagucuacgugaaagccaagaaugucucugauuuucggagaaaauucgacaucuugaaguguaggagcauuaacgaccugcaccacgcacaugaugccuauuuaaauaucgugguugggaacguguuugacaccaaguucacaucaaauccacucaacuuuauuaaaaacaauaguaagaaccgauccuacaaucuggagaaaaucuacgauuaugacguaauacgcaacgaaaagauugcuuggcuugcggagcggaaagaggaaaaucaggauggcucuaucgcaacuguccugaagaaccuaagcaagaaugacaucagagugaccaggcguacauacauuaaaugcgaggaucucuucgacgaaaacaucguucgcaagggaaauggcaaauuuccccugaaggagaacaauaacaaauccgauacuaauaaguaugggggauacucagguauaaagaacgccuauuucguguugcuggaagacgagaagcacaaucggauuaucgaggcuauuccgagcuuuaucuacaagaaagaaaagaacggcgagaaagggagugucauaaacuauuuacagaauauucucggaaucaagucugccaaaauccugagagauaagauuaagaucggcucccuucugaaaauugacaaguucccuuacaacuuggcagguaaaagcgggaauggcauacucaucucgggaggcgugcagcugauucuagauaagaacaccucaaaauacaucaagaagaucgaaaauuauaaauacaagcuggacgagaacaaagacuaucaaauuaauauauuugauaaacuuucuaaggaggaaaacaucaaacucuucgaccuguucguagauaaguuugagaauaguauuuacaagaacagggugaauaucaaguugaaagaaauuaagcuggcccgauccaaauucgagcauuuaagcaucgaggaacagauaaagacacucacccagaugcugauccuuuuugggcgggagaacaaugcuguuaaccuggaauauauuggauugcccaaaaauacugguaagacgaagaucaacaaaaagauuaacaauaaagacaucaagauaauuaaccagucuaucacaggccucuacgagaccgaagaggaucuggccaauauuuga

SEQ ID NO: 3068 - RNA, 4089 nt, Artificial Sequence
  Cas9 variant
augaagaaacccuacagcaucggccuggacauugggaccaacuccgugggaugggccgucauaacagaggauuauaagguuccugcuaaaaagaugaaagugcucgguaauacuucuagagacuucaucaagaagaaccuucugggcgcauuguuauuugauucaggggaaacggccgaggcgaggcggcugaaacgcaccgcucgacguagauacacaaggcggcgcaauagacuaagguaucuccaggaaauuuuccuggacgagaugaacaaacuugauaguggauuuuuccaccggcuggacgauagcuuuuugguaccagaagagaaacgcggcucccgauacccgaucuucgguacucuccaagaggaagugaauuaucaugagaacuuucccaccauuuaccaccugagaaagaaacuggccgacucuaaggaaaaggcagaucucagguuaaucuaucuggcccuugcucauaugauaaaauaccgggggcacuucuuguacgaggagucguuugacucaaauaacaauagcauccaggaaauuuucaacgaguuuacagcagaauaucauaauaccaucgagggaaguugccuguccggccagauugaacaggucgaggccauccuaacugauaagauaucuaaaagcgcuaagcgugagcgcauucucaaacuguucccugccgaaaaguccacaggccuuuucucagaguuccugaaauugaucguggggaaccaagcggacuucaagaagcacuuugaucucgaagagaaaaccccacugcaguucaguaaggacacguacgaagaggacuuagagaaucugcucgaacagauuggagaugaguuugcagaccuuuuccuguuggccaaaaagcuauaugaugcuacucugcucgccgguauccugaccgcaacagacguuagcacuaaagcuccccuuucugccuccaugaucaacagauacgaaacccaccagcaagaucuggcggccuugaagcaguuuauuaagaauaaacucccugagaaguauucagaaguguucagcgaccugaguaaagauggcuacgcaggguauauaaacggaaagacaacccaggaggcuuuuuacaaauacaucaagaacuuacugauuaaguucgagggcgccgucgacuuucuagaaaagaucgagagggaagauuuccuccggaagcagcgaacguuugacaaugguucuauaccacaucaacugcaccuucaggagaugaacgcuauuuugcgcagacagggggaucauuaucccuuccugaaagagaauagggaaaagaucgagaaaauccucacuuuucggauuccuuacuaugugggaccacuggcccgcggcaacagagacuucgcauggcuuacacguaauuccgaccaagccaucaggccguggaacuucgaagagguaguugauaagaccagcucggcugaagacuuuauuaauaagaugacuaacuacgaucuguauuugcccgaggagaaagugcucccuaagcacucuauacuguacgaaacauucgcggucuauaaugaguuaaccaaagugaaguuuaucgcagaaggccugcgggacuaccaguuccuagauuccgggcagaaaaagcagauuaucaaccuccuguuuaaagacaagcgaaaggugacggagaaagauaucauucacuaccuucauaccgucgacggauaugaugguauagaauugaagggcaucgacaaacaauucaaugccucacugaguacauaccacgaucuccugaagauuaucaaagacaaggauuuuauggacgacgcugauaacgaggccauuuuagagaauaucguucauacucugaccauauucgaagaccaggagaugaucaagcagagccuugcacaguaugaugccauuuuugacagaaaagugaugaaggcuuugacaaggcgccacuacacuggguggggagaacucuccgccaaacugaucaacggcauucgggauaagcaaaccgguaaaaugauccuagaguaucugaaggacgauggggaaauaaauagaaacuucaugcagcucauuaacgacgauucucugagcuuuaaggagacaauccagaaagcacagguaauuggcgagaccgaaaauaucaagcaaauagugcaggagcuuccaggaucacccgcgaucaaaaagggcauuuugcagaguaucaaaauugucgacgaacugguggagaucaugggguacaacccugaguccauaguuguggaaauggcuagggagaaucaguucacuaaccaaggacgccgaaauagccagcagcgguuaaagaagcucacggauucuauuaacaaacuggguucaaguauccuugaggaacauccagucgacaauagccaacugcagaacgaucguuuguuucucuauuaccugcagaauggcaaggacauguacacaggggaagcccuagagcuguccaaacucucuucguaugacguggaucacaucauuccccaggcauucaucaaggacgauagccuggacaacagaguacuuguuuccuacgccaaaaauaggggaaagucagaugacgugccgaguuuggagauuguccaaaaacgcaaggcuuucuggcggcagcuguuagauucucagcucauaagcgaaagaaaguuuaacaaucugaccaaagccgagaggggcggucuuacugaagacgauaaggcaggguucaucaaacgacagcugguggagacccgccaaauuacaaagcacgucgcucagauccuagacgcccgguuuaacaccgaagugacugagaaaggcaagaagaaaagagcgguuaagauuaucacacucaaauccaaucuggugucaaacuucaggaaggauuuugaguuguauaaaguacgugaaauaaacgacuaccaucacgcccaugacgcuuaucugaaugcagucgugggaacggccuuacucaagaaguacccuaaacuggagcccgaauuuguuuauggcgauuacccaaaguacaacagcuaucgcgagcggaaaaccgcuacugaaaagguguacuuuuauucuaauaucaugaacuucuuuaaaacaaccgucaaacuugccgacggguccgagaagaagagacaccagauugagacaaaugaagagacuggagaaaucgugugggauaagaccaaacacuucgagauuguaaggaaggugcugaguuacccucagguuaacaucgucaaaaagacggaggaacaaaccgugggucagaauggcggguuguuugacaacaauauagugagcaagaacaaagucguugaugcaucuaagcucauucccaucaaauccggacugucaccagagaaguauggcgguuacgcgcgacccacaaucgccuauagugugcuagugauugcugacauagaaaaagggaaggccaaaaagcugaagcggaucaaagagaugguaggcauuacuauccaggauaagaaaaaguucgaagcaaauccuauugcuuaccuugaggaguguggauucaaaaacaucaauagcaaccauauaaucaagcucccaaaguacucgcuguuugaguucgacgauggccaacgcagauugcuggccuccucuauugaauuacagaaagggaaugaacucauccugccguaucaccuuaccgcacuguuguaccaugcccagaggauuaacaagaucagcgagcccauacacaaacaguaugucgaagcucaucaaaacgaguuugaggaacuccugacaacuauuaucucacuaaguaagaaauacauccagaagccuaauguggagucccugcuucagcaggcguucgaccaaaccgaugaagacauuuaucagcucucugagagcuuuaucucccuguugaaguuaauaucauucggagccccaggcgcauuuaaauuccuggguguugauauuagccagaguaacgugcgguaccagucugucuccagcugcuuuaaugcuacgcucauccaccaaucgauuacagggcuguaugaaacccgaaucgaccuuucaaagcugggagaggacuga

SEQ ID NO: 3069 - RNA, 4089 nt, Artificial Sequence
  Cas9 variant
augaacgagcccuacggcguggggcuggacaucggaaccaauagcgucgguuggacaguuguggauaugaacggcagaguaaggaaggugaaagggaagacugcccucggagcucggcuuuucaaagaaggcgcaacggccgaggaccgccgagguuuucguaccacaagaaggcggcugaagcgcgucaaauggagauugagguuacugcgggaguucuuugaucagccuauuuccaagauagacccaaauuucuuugcgcgccgaaaguauucugauaucucaccgagagaccccaacuacaaugggcuagcuaaaacucucuucaacgauaggaccgacaaggaauuuuaugaugacuacgccacaauuuaucaucugcgggauaaacuuaugaccaguaaucguaaguucgacauccgcgaaauuuaccuggcaauccaccacauagugaaauauagaggaaacuuuuugaggacuggcccugccagccaauacggcuccgcuucucuccaucuggcaacaucguuccagaagcugaaugaucucuuugcccagucagaggagaccuuaaaccugaaacuuguuacggacgaagccuugcugcagcaaauccagcagauucuagugcggacugaccucagccgaagugagcagcaacgccagaucuggccacugauggccguccuuaccggggcguccgcagccgaaaagaagagacagaaaaaugugguaguugagcugucuaaggcuuuggugggacucaaagccaagaugaacgucgugacacugacugagguggaugcagcugucguuaaagacuggaccuucacaauggaagagagccaggauaaguuacccgaaauugaggaacaacuguccgaggugggucagcagaucauggacgagguaauacaacucuacgccucagugaaucuugcgcagcugauuccugccggcaagagguuuagucagcacauggucgaaaaauauaagcaucacgagaaaaacuuggaacuacugaagaccuacauccacagccagucugauuccaaacgggggcgcgagauuagagcaacguaugacagguacaucgauggaguggacucaaagccaguuacucaagaaauguucuauaaggaucucaugaaauacguggaggcugacgccacaagcaaucaucuggcugccgagaucaaggaugaaauugacagugagcaguucaugcccaaacuucguaccaagcagaacggcucuauaccuuaucagguccaacaguacgaacuggaccagaucauuucccaccagaaaaaguacuauccaugguugggugaggaaaacccgguggcagagcggcgagggaaguuucccuacaaacucgaugagcugguaggauucagaguuccuuauuacgugggcccauuaaucacuaaggaagaccaacaggccacaagcggcgcuggguuugcguggauggucaggaaagcagauggacccauaaccccuuggaauuucgaccagaagguggaucgcauugccucggcuacggccuuuauccagcggaugcaaaccacagacacuuaucugaucggugaggauguccuaccagcaagaucucucauuuaccagagguucauggugcugaacgaacuuaauaacaugcgcguugaggaccgaaaauuggcuccccagcaaaagcagcggcuguauaaucagguguuuaagcagcaucaacacguauccgucaaaaacauccagcagaaucucauggaugcuggcgaguaccgugaagccccgaagauuaccgggcuggcagacccuaaaggauucaacucaagucuuagcacauaccacgauuuuaagaaaauacugcccgaggcgaucgcugacgaacauaagagagccgauauugagaaaaucaucuugugguccacuaccuucgaagacucugcaauuuuuaagcagaagcucgaggagguggccuggcugacagacgcucaaaggaaacaguuaagcggccugcgcuaucgggguugggggcagcuaucacacaagcuccugauagccuucaaagaugacaauggcagaaguaucauggauggacuuugggaaaccuccgacaacuuuaugcaguugaggaagcaaccagcaauugagacucagaucaaagaagcuaaucaggccaaccugacggaugcggacauucaagauacaaucaaugagcucuacaccagcccucagaacaagaaggccauacgagaaguuaugcugguguuagacgauaucaaaaaugcuaugcauggccagacucccucuuggauuuucgucgaggcagcccgcgggggagguguggcuggccggagaacccagucaaggaguagccaaaucguagaggccuauaaggggacagcaaaagaaauuguguccgagaagguucagcacgaacugaacgagaaaaucaaggcgaaggccgacuucaacacccgucuugucuuguacuuucuccagaauggacgcgaucuguauacuaacgaagcuauaaauauugaccggcuaucugaguacgauaucgaccauauucugccacagucgcucgugaaagacgauagccuggacaacagagugcuuacauccgccaggaucaaucgagagaagaacgauacguucgcaucagaaaaauuuggccggaagaugggugcucaauggcgcgaguugcacagaaaugggcugaugacccagaggaaauuaaagcaccuccugaugcggcccgacgaaauaaguaagcaugccacugauuucaucaaccgacagcuugucgagacaagacagguuauuaaacugguggaggaauugaucucuagcgaguauccugcagccuccauuguggcuguaaaggcgaaucucacccaccaauuucgccagacauucaacuuuccaaaacugagggaagucaaugacuaccaucacgccuucgaugcaucacuaacugcuuuuaucggcauguaccugcucaagcaguauccgaaacuggagcguuucuuuguguacggaaaguucgccaaacagcccauaaaccuuacccgguuuaauauuaucagaaaguuggccguugcugaaaagccuaucgcaaacauugagacgggcgagauccugugggacaaaaccgccgauauuaaguauuucgaaaaauuauacaauuauaagaggcuccuggugacacacgagguccgcgaaaacuacggggcgauguucaaacaaacucuuuuuaaggcuagcgacaacaagucuaaaacccuggugccaaagaaaaaucauauggagacauccguuuauggagguuacaguaaccaggaaacugccuaccuagcaauagugcgaauccccuucaagagcggcuuuaaauucauuguagucgggaucccuaccagaaugguggccaagauuaagcacuaucagucucucggagcuacgcugaaacaagcaacacauaaggugaucgagccaaaauuuaccaagauaucccggaaaacuaagcagacagucaucucagauuacgagguuguguugcccaagguauaucuggaccagguggucagggaccaggugaaaggccaaauguaccgcuucaguuuagguagcgauaaggaauaucacaauguucaggagcucuaccugccgcuuucgauucagcaggccuuuguggggcauuaugacgaauccgaugaccaacguucuaacgaucuggucaaaguguacgacgcggcuuugaagcagcuccagagauacuucccucugcaccuaagccggaauuuugaucagguugccaaccaagcacaccagucauucgagggccugaaaaauaacgugcagaagagugacaagcaacuuggcaaaaaggaaguccucaauucccuguuuguaggauugcaugccaccgcuacuaggucuaaccugagcguguuagggauguccaaagauuucggacgccuccagucacgaagcggcaucacccugacagaccaggccgagauuaucuaucagaguccaacgggucuuuucgagagaaagguugcacugaaagauuuguga

SEQ ID NO: 3070 - RNA, 4089 nt, Artificial Sequence
  Cas9 variant
augaccaagcugggcaaacccuacgggaucggaguggacauugguagcaacuccauaggcuucgccgcugucgaugaaaauucucaccucaucagacuuaaggggaaaacaguuauuggagcaaggcuguuugaagagggcaaggccgcggcuaaacggcgcgccggucgaacuacgcguagaagguugucacggaaccgcuggagauuaaguuuccugagggacuuuuucgaaagccauaucaccccuacagauccaaacuuuuucaugcggcagaaguauuccgagauuucuccgaaggacaaagcacgcuacaaguaugaaaaacgacuauuuaaugauagaacugacgccgaguucuaccaacaguauucgaccauguaccaccucaggaaucggcugaugacagaucccucacgugcugacgugcgcgagaucuauuuugcaauacaucacauccuuaagagcagagggcauuuccugaccccuggagaugccaaagacuuuaacacuaaugauguagcuuuggacgaaauuuucccagcccuccaggaugcguacgcacagguguaccccgaccugggcaucacauuugacgaggauaaggccaacgaguucaagaccauucugcucaaugagaucgcuacgaguauagacacucaaagggccuuagucaaacugcuuuuggcagaggaagaugacaaggauauucugaaacagcagaaacaggugcuaaccgaguucgcuaaagccguugugggccucaagacaaaacugaaccuugcgcuggggacugaagucgacuccucugaggccaccgcauggaauuuuagcuugggacaacucgaugacaagugggcugguaucgaauccgccaugacagaugagggcaccgagauucuggaccagauccgggauuuauaucgagcucgccugcucaacgggaucgugccuacgggaaagacucuuucacaggccaaaguagacgacuacacacagcaccacgaagaucugcaauuguucaaggcauaucuaaaacagcuggaggacgauggcaccgccaaggcuauuagacagcucuacgacagguauauagauggugacgaugcggcaccauuucugcgggaaaauuucguuaaagcccuuacuaaggacgugacagcucaucccaacaccaagaguccugagcuguuggaacgccucgcccaaccagauuuuaugcugaaacagagaaauaaggcaaacggggccaucccgguccagaugcagcaaagggaguuagaccagauuaucaaaaaccaggcuguguacuaugauuggcuggccgcacccaauccuguggagaagcaccguaaaagcaugccauaccagcuagacgaacuccugaacuuccggauacccuacuaugucggaccucuuguuacggcgaaggagcaaaaggcugcccagggcggcguguuugcauggaugguacgaaaagauccagaagggaauauuacccccuacaacuucgacgagaagguggacagagaagccucugcuaauacauuuauccagaggaugaaaacuaccgauacauauuugaucggagaggacguccugccgaagcagucccuccuguaccaacgcuaugaggugcuuaacgaacugaauaacguucgggugaauaacgagaaauugucaauugaacagaagcagcaggucaucagagagcuuuucgagaggcauaauagcgugacuauuaagcaauuugccgaaaaccugcgcgcacacggugauuacgcucacauaccugagauccgaggcuuagccgacgaaaaacgguuccugaguucucuauccaccuaucgucagcucaagagccugcuucccgaggcgauugaugacccagccaaacaggcugauaucgaaaauaucauugcauggucgacaguauuugaggacgccgcuauauucaagaccaaauugaaggagaucucuuggcugggguccgaagccauuacuaaacucucaaacaucagauacaggggauggggccaauucagucgcaaguuucugaaugguuuaacgcuggggaacggccauacaauuauccaggagcuuuugcucagcaccaacaaucugaugcagauacuaacugaugaaacccugcagaagaaaaugacagagcucaacgcagacaagcugaaaaccgcgaauaucaacgaugccauugacaaugcuuacacuuccccuucuaacaagaaagcccuucggcaaguuuugagaguggucgaugacaucaagagggcagcugacggacaggaucccagcuggcuguauguggaaacagccgacggcgggggaacgccagguaagcgaacccgcgcacggcagcaccaguuacaagagauuuacgccaaugcugcgcaugagcucaucgauacugccgucagaggcgaacuggaggacaaaauaucagauaaggcagacuucaacgauaggcuugugcuguauuuuaugcaagggggacgugacauuuacacaggcgcucccuugaauaucgaucagcucaguuccuaugacauugaucacauccugccucagagccuaauaaaagacaacucucuggacaaucgcguucucgugcaugccaucauuaaccgggaaaagaaugccaccuucgcuucaacaaucuacgcacagaaaaugaacgccacuuggagacaguggcacgaggcgggucugauuagugggaggaaacuucgaaauuugcagaugcggccagaucaaaucgacaaguaugcuagcggcuuuguagcccgccagcuggucgaaaccagacagauaauuaaguuaacggagcagaucguggcagcccaauacccggauaccaagaucauugcuguuaaagcaggacucucccaccagcugagggaggaacuugaguuccccaagaaccgggacgugaaccauuaccaccaugccuuugaugcguuccuggcugcccgaaucggcacauaucuacucaaaagauuuccuaaucugcaggcauucuuuacuuacgggaaguucaccaaggccgacgucaaaaaguugcgcggauuuaacuucauuagggauauaacacacgcugaagacaaaaucguggccaaggauacuggugagguagugugggacaaacagcgugauguugacgagcuggaucggauuuauaauuucaagagaauguuaaucacccacgaagucagguuugagacggcagaccucuucaaacaaacaguguacggcgcucgcgacucuaaggaagccgggggaucgaagcagcugauuccaaagaagaaaggcuaucccguggauaucuacgguggguauuuucgagagaacaccgcguaccuugccgucguuaaggugacuaaaaagacagaaaccauauucaaggugguaaaaaucgcaacuagccaggucgcugcccugaauaaggcuagaucccggucaaccgcagaggaguugagugugcucacagaacugcuaaaaccuaaguuuucuaaaguuggcaagaacggaaagauuacggacaccccauucgaggugguccugcccagggugccgcgcgaacagcucuuuuacaaugccaaauauggcuucuuuaugguuaacagcgauacuauguuccauaauuuucaagagaucugggugucccguucagaccagaagauucuccagcagaucagaaaagccaagauagauuacccuaacguagaccaagaucuggacaauuuguuccacaaccuggcugaucagauugucaaauauuucgacuuauacagcaucgcgggguuuaaggaaaagaucucucagucccaaaauacauucaacgaucucgcaguggacgauaccgaccagagugugggaaaaauuacagucauaaaugagcugcuuaagggcgcccaggcuaacgguaugacugggagccugaaaguuuugaagaucucuaccccauuuggauucacgcaggacaaauccggcgugcucacaaaggauucaaguauuaucuaucaaagccccaccggucuguuugagcggucgguaaggcuaacugaccuguga

SEQ ID NO: 3071 - RNA, 4089 nt, Artificial Sequence
  Cas9 variant
augaccaagcugggcaaacccuacgggaucggaguggacauugguagcaacuccauaggcuucgccgcugucgaugaaaauucucaccucaucagacuuaaggggaaaacaguuauuggagcaaggcuguuugaagagggcaaggccgcggcuaaacggcgcgccggucgaacuacgcguagaagguugucacggaaccgcuggagauuaaguuuccugagggacuuuuucgaaagccauaucaccccuacagauccaaauuucuucaugcggcagaaguauuccgagauuucuccgaaggacaaagcacgcuacaaguaugaaaaacgacuauuuaacgauagaacugacgccgaguucuaccaacaguauucgaccauguaccaccucaggaaucggcugaugacagaucccucacgugcugacgugcgcgagaucuauuuugcaauacaucacauccuuaagagcagagggcauuuccugaccccuggagaugccaaagacuuuaacacuaaugauguagcuuuggacgaaauuuucccagcccuccaggaugcguacgcacagguguaccccgaccugggcaucacauuugacgaggauaaggaaaacgaguucaagaccauucugcucaaugagaucgccacgaguauagacacucaaagggcuuuagucaaacugcuuuuggccgaagaggaugacaaggauauucugaaacagcagaaacaggugcuaaccgaauuugcaaaagcuguugugggccucaagacaaaacugaaccuugcccuggggacugaggucgacuccucugaagcgaccgccuggaauuuuagcuugggacaacucgaugacaagugggcagguaucgaguccgcuaugacagaugagggcaccgaaauucuggaccagauccgggauuuauaucgagcccgccugcucaacgggaucgugccuacgggaaagacucuuucacaggcuaaaguagacgacuacacacagcaccacgaggaucugcaauuguucaaggccuaucuaaaacagcuggaagacgauggcaccgcaaaggccauuagacagcucuacgacagguauauagauggugacgaugcugcgccauuucugcgggagaauuucguuaaagcacuuacuaaggacgugacagcccaucccaacaccaagaguccugaacuguuggagcgccucgcucaaccagauuuuaugcugaaacagagaaauaaggccaacggggcaaucccgguccagaugcagcaaagggaguuagaccagauuaucaaaaaccaggccguguacuaugauuggcuggcugcccccaauccuguggaaaagcaccguaaaagcaugccauaccagcuagacgagcuccugaacuuccggauacccuacuaugucggaccucuuguuacggcaaaggaacaaaaggcggcucagggcggcguguuugccuggaugguacgaaaagauccagaggggaauauuacccccuacaacuucgacgaaaagguggacagagaggcaucugccaauacauuuauccagaggaugaaaacuaccgauacauauuugaucggagaggacguccugccgaagcagucccuccuguaccaacgcuaugaagugcuuaacgagcugaauaacguucgggugaauaacgaaaaauugucaauugagcagaagcagcaggucaucagagaacucuucgaaaggcauaauagcgugacuauuaagcaauuugcugagaaccugcgcgcccacggugauuacgcacacauaccugaaauccgaggcuuagcugacgagaaacgguuccugaguucucuauccaccuaucgucagcucaagagccugcuucccgaagccauugaugacccagcgaaacaggccgauaucgagaauaucauugcuuggucgacaguauuugaggacgcagccauauucaagaccaaauugaaggaaaucucuuggcugggguccgaggcuauuacuaaacucucaaacaucagauacaggggauggggccaauucagucgcaaguuucugaaugguuuaacgcuggggaacggccauacaauuauccaggaacuuuugcucagcaccaacaaucugaugcagauacuaacugaugagacccugcagaagaaaaugacagaacucaacgccgacaagcugaaaaccgcaaauaucaacgaugcgauugacaaugccuacacuuccccuucuaacaagaaagcccuucggcaaguuuugagaguggucgaugacaucaagagggcugcagacggacaggaucccagcuggcuguauguggagacagcugacggcgggggaacgccagguaagcgaacccgcgcccggcagcaccaguuacaagagauuuacgcaaaugccgcucaugaacucaucgauacugcggucagaggcgagcuggaagacaaaauaucagauaaggccgacuucaacgauaggcuugugcuguauuuuaugcaagggggacgugacauuuacacaggcgcacccuugaauaucgaucagcucaguuccuaugacauugaucacauccugccucagagccuaauaaaagacaacucucuggacaaucgcguucucgugcaugcuaucauuaaccgggagaagaaugccaccuucgccucaacaaucuacgcucagaaaaugaacgcaacuuggagacaguggcacgaagccggucugauuagugggaggaaacuucgaaauuugcagaugcggccagaucaaaucgacaaguaugcgagcggcuuuguagcucgccagcuggucgagaccagacagauaauuaaguuaacggagcagaucguggccgcacaauacccggauaccaagaucauugccguuaaagcuggacucucccaccagcugagggaggagcuugaguuccccaagaaccgggacgugaaccauuaccaccaugcauuugaugccuuccuggcggcucgaaucggcacauaucuacucaaaagauuuccuaaucugcaggccuucuuuacuuacgggaaguucaccaaggcagacgucaaaaaguugcgcggauuuaacuucauuagggauauaacacacgccgaggacaaaaucguggcuaaggauacuggugagguagugugggacaaacagcgugauguugacgaacuggaucggauuuauaauuucaagagaauguuaaucacccacgaggucagguuugaaacggccgaccucuucaaacaaacaguguacggcgcacgcgacucuaaggaggcugggggaucgaagcagcugauuccaaagaagaaaggcuaucccguggauaucuacgguggguauuuucgagaaaacaccgccuaccuugcggucguuaaggugacuaaaaagacagagaccauauucaaggugguaaaaaucgccacuagccaggucgcagcucugaauaaggccagaucccggucaaccgcugaggaauugagugugcucacagagcugcuaaaaccuaaguuuucuaaaguuggcaagaacggaaagauuacggacaccccauucgaagugguccugcccagggugccgcgcgagcagcucuuuuacaaugcaaaauauggcuucuuuaugguuaacagcgauacuauguuccauaauuuucaagaaaucugggugucccguucagaccagaagauucuucagcagaucagaaaagccaagauagauuacccuaacguagaccaagaucuggacaauuuguuccacaaccuggccgaucagauugucaaauauuucgacuuauacagcaucgcuggguuuaaggagaagaucucucagucccaaaauacauucaacgaucucgcgguggacgauaccgaccagagugugggaaaaauuacagucauaaaugagcugcuuaagggcgcacaggccaacgguaugacugggagccugaaaguuuugaagaucucuaccccauuuggauucacgcaggacaaauccggcgugcucacaaaggauucaaguauuaucuaucaaagccccaccggucuguuugaacggucgguaaggcuaacugaccuguga

SEQ ID NO: 3072 - RNA, 4089 nt, Artificial Sequence
  Cas9 variant
augaccaagcugggcaaacccuacgggaucggaguggacauugguagcaacuccauaggcuucgccgcugucgaugaaaauucucaccucaucagacuuaaggggaaaacaguuauuggagcaaggcuguuugaagagggcaaggccgcggcugaccggcgcgccucacgaacuacgcguagaagguugagucggaaccgcuggagauuaaguuuccugagggacuuuuucgaaucccauaucaccccuacagauccaaacuuuuucaugcggcagaaauauucugagauuucgccgaaggauaagucacgcuacaaauaugaaaagcgacuauuuaaugacagaacugaugcagaguucuacaaauaugagaauugccccaccauguaccaccucaggaaccggcugaugacagacccuagcaaggccgaugugcgugaaaucuauuuugcuauacaucacauccuuaaaagucgcggucauuuccugaccccaggggacgcaaaggauuuuaauacuaacaagguagccgugaauaaaauuuuccccgcuuugcaagacgccuacgcgcaggucuacccugaucucgacaucacauuugacgagaacaaggugaaugaguucaaaaccguucugcugaacgagaaggcaacgccauccgauacucagagagcccucgugaauuuacugcuugcuaaagagggagacagggauauuuugaagcagcaaaaacaggcccugaccgaguucgcaaaggcugucgugggccuaaagacaaaacucaacguagcccugggcacugaaguugacucuagcgaagcgaccgccuggaauuuuucccuugggcagcuggaugacaaguggacaggaaucgagucagcaaugaccgaugaagguacggagauauuggaccagauucgggaucucuaucgagcucgccuguuaaacggcaucgugcccgccgggaaaacucugagucaagcuaaggucgacgauuacgcccagcaccacgaggaccucgaacuuuucaaagacuaucugaagcaguuggaggaugacggaacagcaaaggccauuagacagcuauacgauagguauaucgacggcgaugacgcuaaaccuuuugugcgggaagauuucgugaaggcgcugaccaaagaggucacugcacauccaaacgccaagagcccggaacuccuggagcgccuugcucaacccgacuuuaugcugaaacagagaaauaaggccaacggugcaaucccuguucagaugcaacagagggaguuggaucagauuauaaagaaucagucuguguacuaugacuggcucgccgcuccaaaccccguagaaaaacaccguaaguccaugccuuaccaacuggaugaguuacugaauuuccggaucccauacuauguggggccccuagucacagccaaagaacagaaggcagcgcagggaggcguguuugcuuggaugguucgaaaagacccggauggcaacauuaccccuuacaauuucgacgagaagguggacagagaagccucagcaaacacguuuauccagaggaugaagaccacagauacuuaucucauaggggaggacguccugcccaaacaaagccuuuuguaccagaguuaugaggugcugaaugaacucaacaauguacgcguuaacgauaauaagcugucuuucgaccagaaacagcaagugcuuggagagcuguuugaacggcauaacaccgucacaauuaagcaguucguggauaauuugcucgcccacggugacuacgauagaaucccagaggucaggggccuggcugacgagaaacgcuuuuuauccagccugucgacuuauaaccagcuaaaggggauccuccacgaagccauugaugacucugauaaacagaccgacaucgagaacauuauagcaugguccacaaucuucgaagauaaggcuauuuucaagaccaaacugaaugagaucucauggcuuaacgccggaaugaucaauaguuuggcgaacauucgauaccggggcuggggucaauuuagccauaagcugcucaaugaacugacuuuauccacggggcguacaguguucgaggagcugcuuauaucuagccacaacuugaugcagauccucaccgacgaaguucugaaacagaagauugccgagcuaaaugcucaugaacugaaagcaucaggcaucuacgccgcuauugacgaugccuauacuagcccuuccaacaagaaggcacucagacaagugcugagcguaaucgacgauauaaccaaugcggccggacaggcucccaacuggcuuuacaucgagacagccgacggcgauggggucccaggaaaaaggaccaauucucgccagcggaagauucaggaaaucuaugcaaacgcugcccaagaguugauuacugguucagugagaggcgagcuggaagacaaaaucgcaaguagggccgauuuuacagaccgauuaguucucuacuucaugcaagggggacgcgauauauauacgggcaagccccugaauauugacaaccuuagcuccuacgauaucgaccacauucugccucagucuuugaucaaagacaauucgcucgauaaccgggugcugguccauccacuugugaacagagagaaggacaccauauuugcuagcacuagguucgcgaagcagaugaaugguauguggcgucaguggcacgccgcagggcugaucuccucacgcaaacuccggaaccugcagaugagaccggaugaaauugacaaguaugcuaguggcuuuguagccaggcagcuuguggagacacgacagaucauuaaauugaccgaacaaaucguugccgaucaguaccccgacacaaagauaauugcugucaaagcaggacugucuagccaguuacggaaggagcucgauuucccuaagaaucgcgaggugaaccacuaccaucacgccuuugacgcguuccuggcugccagaaucggcacuuaucuucugaaaagguacccaaaucuagaacccuuuuucaccuaugggaaguuuaaaaagacggaggugaaaaagcucaaauccuucaacuucauccgggauaugacccaugcaaaggacaagauugucgccaaagaaacaggagagaucguuugggauaaugcuucagacauuaacgagcuggaucgaauauacaauuuuaagagaauguugaucacucacgaagugcgcuucgagaccgcaagccuguuuaaacaaacauuauaugccgcgaagaacucuaaaaauagggguggcucccgucagcucauuccuaagaagaaaggguaccugguggacaucuauggaggcuacacucaggaaaccgguaguuaccuuagcguaguccggcugacgaagaaagcuauguaugccgugguuaaggugucuacaagagacgcagccaaauuggcugucgccaaguccauuucagagcagaaggaaaacgagacccucaaaaagaucauagaugggaaacugaguaagacuagcaaaaagggcaagacaacccaccaacuauucgagaucgugcugccaaggguuggacagaaaacucuuuuuaaaaauucgaaguacaaccaguuccucguaaauuccgacaccuauaugcauaacuaccaggaacuguggaugccccgcgaguaucaacgaauguggaaggauauuuugcugucuaaccacggcgacgcacaguuagaagggcagcucgaucagaucuuuaaauucauugugagccaagucaauucauacuuuaaccuguaugacaucaaucaguucagaaagaagauagcugaugccacagacaaauuugcgaagcuaccgacgcaugauaccgacaacgcccggggaaaaauugcaacuaucggccagcuguugaucggucuccaggcuaaugccaugaggagugaucugcgcaaccuagacauuaagacaccuuucgggcugcuucaaauaggaaccggcaucacacucgaucuggacacuuccauuaucuaccagucuccaaccgguuuguucgagcgugaagugcccuuaacggaccuguga

SEQ ID NO: 3073 - RNA, 4089 nt, Artificial Sequence
  Cas9 variant
augaaccaggagcccuacgccaucggccuggacauugggaccagcucccucggaugggcuaaugcagauauggacgguuauauagccagagugaagggccaaacagggcuuggagucaggcuguucgaagagggccagccugcggcugaucggcgcucuuuucgaacuacgcguagaagguugucacggcgcagauggagguuacggcugcuacgcgaaaucuucgacgagccaauuaguagcaucgauccgaacuuuuucgcccgacagaaagcauccucuauuucgcccaaggacgauagauuugaaaccacauaccagcuuuucaaugacaaaacugaucaagaguuuuauucaaaguacccuaccaucuaucaccugaggugggcccuuaugacagagcaucggaaauucgaccugcgugaaauauacuuggcuguucaccauaucgugaaguaucgcgguaacuuucucagaagcgggaauccaaagaguuucaaacccuccgagcuggauuuuucucagagguucaaggaaguaaacggacuguggcaccucauuuuugacgagguggcaccucaguuaccaaccgauaaucuggaggaaaucacuaaacuugucuuggacacaacccggacgcgagccgaccgccagagagagagcgugaagcugcuaauggcugccacugauaaccauaaagacuggaagcccuaccucaccgaguucacaaaggcgauucugggccuuaaaacuaagcuguacuugcucaccggcguugauguggcaaaagccgaccaaaagacauggaccuucucccuggaagauaucgaagaccacagggcugauuuagagacggccuuugacgaucggucacuggagcucauagaaaaacuugucgaccugcaggcagcuauucaguugacugagaucaugccuagugggcaguauuucagccaaucuaugauuuaccgcuaugaucagcacaaggaacaucuaagauggcugaaagacuacgccgagcagcaaacagacgcgaauaagaggaaggccgugcgucucgcauaugaucacuacaucgaaggagacgcuaaagguaagccagagaucgccgaugacuuuuauaaagagcugaaccggauucuuaagggcgauaccuccgaacuggcuaaaaagauaaaucaugagaucgccuuggaacacuucaugccgaagcagcgaacuaaagagaacgggguaauucccuaccagauccaccagcaagaacucgacucaauaauugauaaucagaagaaauacuaucaguuucugggagaggacaacccuguugugagccaucacggcagucagccauacaagaucgaugaguuagucucuuucagagugcccuauuacguggguccuaugaucacagcagaccaacagaaaaagaccgccgcugggcaguuugcguggauggucaggaaggauuccggagacauuacgccauggaauuucgaugacaaaguugaccgcaccgcaagcgccacaaacuuuauccagcggaugaagacuaccgauacauaucugauuggcgaagacgugcuaccccuccaaucgcugacuuaccagaaauucaugguacuuaacgaguugaauaacauaagaaucaauggcgaacugcucaccagggagcagaagcagcgcacauauaacgauguguuuaaagggcauggaaccgucaaugugaagucucugauuaagucccuugagugccacucagaaguuacuggugcuaucaaaguggagggccuggccgacccgaagcgauucaacagugcauugacgacauaccgggauuuuaaaaagauccucccugucgccauugaccaaccccagcgucaggcugauauagaaagaaucauuaauuggagcaccaucuucgaggacgccgauauuuucaaagcaaagcugcaagaaaucgacugguuaacugauacccagagggaccgccuguccacaaaacgguacagaggguggggaaggcuaucugcgaagcuccugcuuaacauaaaggauacccagggcuugagcaucauggaccagcuguggaauacucaacauaacuuuaugcagauugugcacgagccagacuaugcugagaaaaucgaaaagacaaaugccaaaggucucaagcagcaggauauuuucgagacgaucaacgaaauguacaccucaccucaaaauaaaaaggcacugcgacagauauuagccguaguucgcgacauucagaaggcucaccaugggcaggcccccagucggaucuuuauugaggcagcuagaggcgccgaacaaaacccacagaggacucgucagcgccaaaaacagcuggcggaucuuuucgccgaccaggcuaaggagaucgugaaugagacagucgcacaggaauugaacgaugagaccgacaacaaagcccgguuuacagauagacucaugcuguauuuccuacaaaauggacaggacauguacacuggcgaaaagcugaacauagauaaacucuccaccuaugacaucgaucacauucugccccagagccuugugaaggacgacucuuuggauaauaggguccuggugucaaagguugagaacuuaaagaagaaugaccauuuugcuagugaacucuacgcccgaaaaaugcaggggacgugggagcuguggcggagcgcaggacuuaucuccgcgcgcaagcugaaacacuugcucaugagaccugaugagauuaacaaguaugccaccgguuucaucaggcggcaacugguggaaacacgacagguaauaaagcuagucacugacgugcugucuaaugaguacgauucggacaaaaccaagauuaucagcguuaaagcuggccucucccaccagcugagaauggaacuugauuugccaaaggugcgcgagcugaacgacuaccaucacgccuuugaugcauucuuagcugucaggaucgggacauaucuccugaaacguuacccgaagcucgagcgguuuuucguguauggacaguaccaaguagcaccccagcuggaccuaagaagguuuaauuucauucaugaucucgugucaggcaaacaggaaaagaucguugccgaggaaacuggugagauugucuggaaccgcgaaaaggacgugaguuauaugaaacaccuguugucucugaagcauuuacucgugacccacgaggucaaagaggaucacggggcccuguucaaucagacgauauacaaggcuaaaaaggacaacggcaauguuggaggcaagaugaaacuucugccuacaaagagcaaccgaccaaccgaaaucuaugggggacauuccucacaagcgauugccuacuuggcaaucgugagagugaaugguaaagagcccagcuaccggguaaugggcgucccuauuaggauccucgaccagcugaagcaggcuaaaaagcaaggggaauaugccgagcgccuagcccugaagcaguuuuucacuccagauuuuacaaaaggaaagggcaaaauagugucugacuucgauguugugaucccccacauuccgcuucuccagccugucaucgacgaaauuuccggucagagucaucguuuugcucuggggaccaacacuuacuauagaaacuugcaacagcugaucuuaacccucgcagaucagaaggugcugauaagcaaagagacaggcguugacgaggaaaagaaacuuguggagguauacucucacauuugucagcaagucaugaaauucuuuccacuguaugaucggaauaaguucagggaauugcucguggacucccgcucacauuuugagcagcugcccaucgugaaccgauacagugaugccggaaaacuagaaaucgcgggcaagagagggauucugcagcagauaauggucggacuucacgcuaaugccacgccuggcgaccucaaagagcuggguguuaagacccccuucgggaaguugcaagugccaggaggcaucaaauuaacugagaacgcaaagcugauuuaugaaagcccuacaggucucuuuaaacgggagguaaagaucaccacagaauga

SEQ ID NO: 3074 - RNA, 4089 nt, Artificial Sequence
  Cas9 variant
augaagaaaaaggccgagaaaaucuaccugggccucaacguggggaccaauagcauuggauaugcugucacagacgaacaguacagacuucugaaguucaacgguaaugaugcauggggcuccauaguuuuugacgccgcgucuucaaacgaggauaggcggaaucaccgcuuggcucgacguaacuuagacagaaggcaacagcggaucguguggcugcaggaaauuuucgccaaagagaucaguaagguagaugaccgcuuuuucauuagacuaagcgaauccuuuagguggcgggaggaugugcaggaccgcuaugucuucuuuaaugauaaggaguacacugacgugcaauauaugaaagaauaccccacgauccaucaccucauaugcgagcugauggauaacaagaccccucaugacguucgacuuguguaucuggcaugugccugguugaucacacacagagggcauuuccucaauaaccugaaugucgaaaaacuggaugagauuauggacuuuucuucgguguaccagaacuucaucaauuacuuuacugagaacggauauaagaggccauggggcgaaauugacguaucagcucucagcgagguuuuaaaacagaagaccgguaucacagugaagaauaaagaacugcagaacauacuuuuggaggggaagaaaccggaaaagaguggaaccgaggaguuccccuuuucccaagauucuauuauccggcugcuagcaggcggccagugcaaacucaaggacgucuucuguaaagaagaguaccuggaucuugggagcgugucccugggaauggacgaagagaaguucgaugaaauuucagguaguaucggcgaggacuaugauuugcucaucgcccugcguggguuauacgacuggagcgugcuggcuaaccuccuuaauggacacucugagacuauuuccauggccaagguccagauguaugaacagcacggcaaagaucugcaaauauugaaguacuuuguucgcaaauaugugccugacaaguacaacgagguauucagaaaagcgaaggcagauaauuacguggccuauacaggucauauggacaaggacaccgcuucacagaucaaaaagaaagccaaggcagaagaguuuagcaaauacguccuaaagcugaugaguccaauuaagcccgaaaagacggaucuccagucuuaugaggacaugugcgagaggcugaaacuuaaccgguuccugccuaaacaaaagaauacugauaaccgagugaucccacaccaguuguacgaauaugagcucauacagauucugaaaaaugcuuccguuuacuuacccuuucugaacgacaccaauaacgggaucagcgaagccgauaaggugcuaucggucuuccgcuauaagaucccuuacuacgugggaccacucaaugaggagucuuccuuugcguggauuucaagaaaacagggcaagaucacaccguggaacuucaaagaaaugguagacgaggaugccagugaaaaugcauuuauuaggcggaugacuaacaaguguaccuaucugcccacagaggacguucuuccuaaagauagcuugugcuaccaaaaguucauggugcugaaugaaauaaacaaccuccagaucgacggccugaaaauuccagucaaggcuaagcaggggaucuaucaugagcuuuuugagaaaaauaagaaagugaagcgcaaagauaucgaagaguaccugauuagaaacaauuauuuggacaaggauuccaccgaacucauaucuggaaucgacgagcagauucacagcggucugucaaguuacugugccuucuuuaacuuacugaauaagaaaauccuauccgaagacgaugucgagaggauuaucgagcgugcuagcuaugccgaagacaagucucgggugauaaaauggcuccgaaaggaguaccccggccugucagaagaugacaucagauacauugcaaggaucaaaauucgcgauuucgggcggcuuaguaagacguucuugacuggacugaagggcugcgacguuagcaaagguuuugaugggcaagacguggagaugaucuccauacuccagacaaugugggaaaccaacgauaaucugauggagauuuuaucugacaaguauacuuuccuggaggcccuugaggcuuuuacacaggaguacuauaccggcaaaaagaaaucguugaaggaaagacucgaugagaugaggguaagcaacuccguccgccgaccuguguaccggacgcuggcgguugugaaggacaucgagaaagcauucggaaagccaaauaaaauuuuugucgaaaugacccguggcgggcaggccgaucaaaagggaaaaagaaucaagucaaggaaacagcagauacuagaccuguaugacaaguguaaggaugacgugcacgaucucauguggcagcuggagagucuuggugaauacgcugacucucgcuugcaaagcgaucggcuguauuuauacuucaugcaguuuggcaaaugcgccuacuccggggcacauaucggauucgagcagcucauggccggcucaguagaauaugacauugaucacaucuacccccaaagcuaugugaaggacgauucucugaacaauaaaguucuuguccuguccgacuugaacgguacaaaggauaauauuuacccggugaguccugagaucagagggaaaaugcagggccucuggagcugguggaaccaugugggagcuauaucugacgagaaguauaagaggcugauucgauccgcccccuuuacugacgaagagaaaaugggcuucaucaaucgccagcuaaccgaaacaucacagaguacuaaguuuaucgcagaucugcucaaagagcgguucccagacgcggaagucguuuacgugaaggcugggcuggugagcgauuuuagacacgaguucgaccuuccuaaaucgagguccuauaacgauuugcauaacgccgcagacgccuuccugucuguagucgcuggaaauguguacgauaugcguuuuagcaagaagugguuccgcauugacgagaaauacucaguuaaggugaaaaccaucuuuacacacgaagucaagugucggggugauauuauaugggacggcaugcccauguuagagaaaguggaagauaccgccagaaagaacacugcacacuucguuaaguaugcugccuuuaaaacagggggacucuucgaccaaaauccagugaagaaaggcacgggucugaucccccuuaaggcggggcugccuaccgagaaauacggcggauauaacaaggccggcauuauguuucuaaucccaguaagguacaauauugggaagaaaagugaaauccucauacugccggucgaguugaugcauggaaagcacuuccuggaggauaaaguguuugcucgaaacuauacuuucacccgguuagaaaauauccucggcaagaaagugggugaggucuccuuucccauggggaugcgcccuuggaagauuaacacaaugcugucuuucgacggauucagaguuugccuuaccggcacuagcgguaggggcaaaugccugguggcacagccaguaaugcaguuuuccgccgacgaacauuggcgguucuacgugaagcgauuggagagauuugucgagaagaucgggauuaaucccgaucuccuguaugacaaagaucacgacaaggugucaaaagaugaaaaccuaaagcuguacgagcuuuacguugacaaacuccagaauacaaucuauaagaagcgcgugaacagcccuguccaaacgcuguugaaaggaaaggaagaguucaaaaagcugaguauagaagaacagugucagguguuacucaauauucagucuguuuuuggcaggaugaccgggggaugcgaucugacucuuaucggcgguuccgcucacagcgccgcaacagggucgcugucaaccacaaucucuaacuggaaaaagaaguacaguacugugcguauuauagaccaauccccaagcggaaugugggagaaaucuagcgaaaauuugcucgauuuccuguga

SEQ ID NO: 3075 - RNA, 4092 nt, Artificial Sequence
  Cas9 variant
augaccaagcugggcaaacccuacgggaucggaguggacauugguagcaacuccauaggcuucgccgcugucgaugaaaauucucaccucaucagacuuaaggggaaaacaguuauuggagcaaggcuguuugaagagggcaaggccgcggcugaccggcgcgccucacgaacuacgcguagaagguugagucggaaccgcuggagacugagcuuccugagggauuucuucgaaucccauaucaccccuacagacccaaacuuuuucaugcggcagaaauauucugagauuucgccgaaggauaaggcacgcuacaaauaugaaaagcgacuauuuaaugacagaacugaugccgaguucuaccaacaguaucccaccauguaccaccucaggaaucggcugcuuacagacccuucaaaagcugaugugcgugagaucuauuuugcaauacaucacaucuuaaagagccgcggucauuucuugaccaguggguacgccaaagacuuuaacacuaauaagguagcucucaacgaaauuuucccagcccugcaggaugcguacgcacagguguaucccgaccuggauaucacauuugacgagaauaaggucaacgaauuuaaaaccgugcucuuagacgagaaggccacgccuuccgauacucaaagagcucugguuaaucuuuugcuggccgaggacggagauaaagacauucuaaagcagcagaaacaggugcucaccgaguucgcaaaggcugucgugggccugaaaaugaaacuuaacguagcccugggcacagagguugauucuagcgaagcgacugccuggaauuuuuccuuggggcaacucgacgauaagugggcaggaaucgagucagcuaugaccgacgaagguacagagauacuggaucagauuagggacuuauaccgggcccgacugcucaacggcaucgugccagcugggaaaacccuuagucaggccaaggucgaugacuaugagcagcaccacgaagaccuggaguuguucaaagauuaccuaaagcaacuggaagacgauggaauggcaaaagugauucgccagcucuaugacagauacaucgauggcgacgaugccaagcccuuugugagggaggacuucgucaaggcucugacgaaagaaguuacugcgcauccuaaugcaaagagcccagagcuucuggagcgguuggugcagccggauuuuaugcucaaacaacgcaacaaggccaacggugcuauccccguacagaugcagcagagagaacuggaccaaauuauaaagaaucagucuguguauuacgauugguuagccgcaccuaacccagucgagaagcacaggcaguccaugcccuaccagcuggacgaacuacucaauuuccguaucccuuauuacguggggccacugguuacagccaaggagcaaaaagcugcccagggaggcguguuugcauggaugguccggaaggaucccgacggcaacauuaccccguauaauuucgacgaaaaaguggaucgagaggcgucagcuaacacuuuuauccagagaaugaagacaaccgacacguaccuuauaggggaggauguauugccuaaacagagccugcucuaucaaaguuacgaaguucugaaugagcuuaacaaugugagggucaacgacaauaagcugucuuucgaucagaagcaacagguguugggagaacucuuugagcgccauaacaccgucacaauuaaacaguucguggacaaucuguuagcccacggugauuaugaccggauccccgagguuagaggccuggcagaugaaaagagguuucuauccagccucucgacuuacaaccagcugaaagggauccuucacgaggccauugacgauucugacaagcagaccgauaucgaaaagauuauagcuugguccacaaucuucgaggacaaggccauuuucaaaacuaaguugaaugaaaucucauggcugaccgcaggaaugaucaacagucucgcuaacauucgcuaccgaggcuggggucaauuuagccauaagcuguuaaaugagcugacacuuuccaccgggcggacuguguucgaggaauugcucauaucuagccacaaccugaugcagauccuaacggacgagguacugaaacagaagauugccgaacucaaugcgcaugagcugaaagccucaggcaucuaugcugcaauugaugacgccuacacaaguccauccaacaagaaagcccuucgucaggucuugagcgugaucgaugacauaaccaaugcugcaggacaagcgccuaacuggcuguauaucgaaacugccgauggcgacgggguucccggaaagagaaccaauucuaggcagcgcaagauucaggagaucuacgcuaacgccgcacaggaguuaauuacagguucagugcggggcgaacucgaggauaaaaucgcuaguagagccgacuuuaccgauaggcugguccuuuauuucaugcaagggggacgagacauauacacuggcgaaccacugaauauugauaacuugagcuccuaugacaucgaccacauucucccccagucucugaucaaggauaauucgcuagacaaccgcgugcugguacauccucucgugaaucgggagaaagauacaauauuugcaagcacgagauucgccaagcagaugaacgguauguggaggcaguggcacgcugcggggcugaucuccucacguaaacuucgcaauuugcaaaugcggccagacgaaauugauaaguacgccaguggcuuuguugcaagacagcuggucgagaccaggcagaucauuaaguuaacugagcaaaucguggcugaccaguacccggaugccaaaauaauugccgugaaggcuggacucucuagccagcugcgaaaagaacuugacuuccccaagaaccgggaggucaaccacuaucaucacgcauuugaugccuuccuggcggcucgcaucggcacauaccuacucaaaagauauccuaaucuggaaccauuuuucaccuacgggaaguuuaagaaaacagagguuaagaaauugaagucccugaaaucauucaacuucaucagggacaugacucaugccaaggauaaaauuguggcaaaggagaccggagaaaucgugugggacaaugccagcgauauuaacgaguuagaccggauauauaauuuuaagcgaaugcucaucacgcacgaaguaagauucgagaccgcuucucuguuuaaacagacacuuuacgcagccaagaacuccaaaaaucgcgguggcaguaggcaacugauucccaagaaaaagggguauuuggucgacaucuacggaggcuacacucaggaaaccgguagcuaucucucugugguucgucugacaaagaaagcgauguacgcuguggucaagguguccacucgggaugccgcaaaacuagccguugcuaagucaauuagugagcagaaagagaacgaaacccugaagaagaucauagacgggaaacuuagcaagacgucgaaaaagggcaaaacaacccaccaacucuucgagaucgugcugccuagaguaggacagaagacuuuguuuaaaaauuccaaauauaaccaguuccuggucaauucugauacauacaugcauaacuaucaggaauuauggaugccaagggaguaccagcgcauguggaaggacauucuccugagcaaucacggcgaugcccaacuugaagggcagcuggaccagaucuuuaaauucauugugucacaggugaacaguuauuuuaauuuguacgauaucaaccaauuccgaaagaaaauagcagacgcuaccgauaaguuugccaagcuccccacucaugacaccgauaacgcgagaggaaaaauugccacaaucggccagcugcuaaucggucugcaggcaaaugcuaugcgguccgaccuuaggaaccucgauauuaagacgccguucgggcuguugcaaauaggaaccggcaucacuuuagaccuggacacaucuauuaucuaccagagcccuaccggucucuucgagcgcgaggucccacugacagaucuuuga

SEQ ID NO: 3076 - RNA, 4092 nt, Artificial Sequence
  Cas9 variant
augagaggcaacuaccacaucgggcuggacauuggaaccagcuccauagguugggccgugaucgaugacaaugcuaaggucaugagggcaaaaggcaagacagccauuggggcgcggcucuauaacgagggacagacugcugccgaucgccgacuuuuccguacgaccagaaggcggcugaaucgcagaaaauggagguugaaguuacuggacgaaaucuuugaucccuacauuacaccuguugacgcagccuucuuugcucggcuaaaacaaucuaaccucucaccaaaggaucagaaucgcgacuggacuggcaguaugcuguucccggaucgaaccgacagaaaguuucauaaagauuaucccacaaucuaccaccuuaggcauaagcugaugaccgaggaccaccaguucgauauacgggaaaucuauuuggcaauucaucacaucgugaaauaccgugguaacuuucucaauacuacaccuguaagcuccuucucugugucggacgucaaguuugacgagcaguucgaucgccugaacgaacuguaugccgcugugucaccagacgagcccuuugccauuaauggggauaacagcaaagcgaucgagacccucuuacugagugacgaaacgaagaaguucgauaaacaaaagcaguccgcaaaacuuauauugucugagacuggagacaaggcccuggauaaagaaaauaccaagguugcuacacagauuagcaaagccauccuaggcuacaagacucagcucgacgugcugcuuaaguacgaugcaauuaacuccucagcuuggaaaaucgagcuggacgaugagaauaucgacgacaccuugccuggccuccugagucaauuagaugaaaacagacaggagauggucagcauuauacagaaucuguaugcccaggugacacucaaccaaaucguaccaaacgggaugucucuuuccgaaucaaugauugagaaguacaaugcgcacagggaccaucugaaauugcuaaagcagcuggaagauaaaaucgacgaucccaagaagaaaaagggacucgaggccgcauaugacgcuuacguugguaaaaacaugaagguggccaaucaggaugucuuuuaugcuagcgugaaaaagaaccuggacgauagugaccuugccaagcaaauagcagaucugauugaggcccagaaauucaugccuaagcagcggaccucucagaauggcgugaucccacaccaauugcaucagcucgaacuggaccagaucauugagaaccaguccaaauacuauccgugguuaacggcugcgaaucccaacccuaagcgaauccaccaagcaaaauacaagcuggaugagcuagucgccuuccgcauuccauacuauguugggccccucgugacuccugaggaacaggaaaagagcgcuaaucagguauuugccuggaugaaaagaaagcagccaggaacaauaacccccuggaacuucgaccaaaaaguggacaggauggcaucggccaaucgguuuauccgcagaaugacuacaaaggauaccuaccugauuggcgaggacguccuuccggaugcuucuuugaucuaugaaagguucaaagugcugaacgagcucaaucugguuaaggccaacuaccaccgucuugcacccgcgcagaaacaggcugccuaucgggaccuguuugaaaaucagaaguccaucucaacgaagaaauugcaaaacuaccucguggaucaggguuauuucaccgcaaagcccaaaauuacagggcugagugacccagagcgauuuaacagcuccuuaggaacuuacauagauuucaaggaaaucuuuggcgaccaggucgauaauccugacagacaagaugacuacgagaaaauuaucgaguggucuaccguguucgaagauaggcagauuuaugaggccaagcugcgcacacuagacuggcucacugaagaccagauccaggcucugaagaccaaacgguacaacggcugggggagacuuagcaagaaauugcugacaggaauaguagaugagaauggugagaggaucauugacguucucuggaacaccaaucaaaacuuuaugcaagugcagucacaggaaaguuucgccaagcgcauccaugaggcaaaugcuaaacagaugaaggucacuggcguggaagauauucuggccgacgcguauacguccccucagaacaagaaagccauccgacaggucauacgggugguugaugacauucagaaggcuaugggagggguggcaccaacaagcguaucuaucgaguuuacccguucagaagaucaaaaucccagaaggacucagagucgcgagagccaguuacaaaacaccuucaaagucgacgccaaggagauuguggauuccgaccugguuacagaacuugagaccgugucuaaaucgaagaagggcuugacugaucggcucuaccuguauuucacacagcuagguaaagacauguacacgggggacccucugaauaucgaugaacucagcaccuaugacauagaucacauccugccacaggcuuuuauuaaggacgauucccuugacaacagagucuuggugucaaaagccguaaauaacggcaagaguaauaacgugccgguuaaacuguucggaggcaagaugggaggguuuuggaaagaguuagcagaucauaggcucaucucuaagcgaaagcugaaacaccuucugacugaccccgauacaauugacaaguacaccaugcgcgguuucauccggagacaguuggucgaaacaagccaagugauaaaacucguggcgcagauucugggcgauaaguaccagaacgacgauacuaaaaucaucgaggucaccgccaagaugaaucaucagaugagggagaacuuuaagcuaauuaaaaaucgugaaguuaacgacuaucaccacgcuguggacgccuaccugacggcauucguggggcaauaucucuacaagcgcuauccuaaacugcggccauacuuuguauauggaaauuucaagaaauuuaacgaggaucaugucuccuucagauacuuuaauuuccuucacgaauugauggacgagaacaauaagaggaucguggaacccgagaccggcgagguugugcuggaacgagagccugcuauugccuacaugaagcgggucuaucauuuuaaauucauguuaauaucacaggaaguguacacacgcagagaugcaauguucaaccagacuaucuauccagccaaggaggcuaauaggcggaaacucauugcgaucaagcacgguaaacccguugacguguacgggggcuauagcggaucuguagaugccuacauggcaauuguccgaauccacgacaagaagggcgauaaauauaagguggugggggucccgaugagagcucuggagauacuuaacgccacccaugacaaaaaggauuacgacgccaaacugaagcagauccuaguuccuaaguuuacaaaagugaagaaaucccgcaagacuggagaaauuaccaaaaagguagaggauuucgaaaucgugcucgguaaagucauguacaggcaacuggugauugacggcgauaagaaguuuaugguugggaguagcacguauuuguacaaugcucgucagcugguguuaucugacuccucacucgacacacuggcaaguaaaggaacccuugauagcgacgccgauucgaagcggcuggucgcgguguaugacgagaucguugaaaaaguggauaaguacuucccauuguaugacaaaaacgcuuuuagauccggccuccacaaggguagggauaaguaccugcuacugcccaaucgcucuacuuucaacggggccaaaaagguccauagcggcaaacgagagauacuuaacgagauucucaauggacugcacgcaaacgccacauugggcgggcugaaggacuuaaaaaucucaaccccuuuuggaaagaugcagggccagagugguaucccccucuccucuaauacuauuauaugcuaucaaagcccaaccgggcuguucgaacauagaguaucccuuaaggaucuguga

SEQ ID NO: 3077 - RNA, 4092 nt, Artificial Sequence
  Cas9 variant
auggagaacaauagauacaacgugggccuggacaucgggaccagcuccauuggauucgccgucacagaugaacaggacgagcucguucaagugaaggguaaaaauuauauaggcguaaggcuuuuuaaggaagggcagacugcuucugagcggcgcucauuccgaacgacccguagaaggcugaaacggcgcaaguggagauugggauuacuggaagagaucuuugcacccuaccuagcccagggcgauccuuauuuccucgcgaggaugaaagagaguaacauuagcccacgggacgaacgcaagaaguacuaugguucccugcuuuucucugaugacacaguguucuacgauaaauauccgacugucuaccaucugcgacacgcuuugaugaccgaggacagaaaguuugauaucagggaaauuuaccucgccgugcaccauaucauaaaauaucgggggaauuuccugaucaacacacugauuaaugaguuuucgucaaaggcaguugacuucaaaaaggaugccgacauccucaacgauuuauuugagcaguucuacauuagcgacaucaaugacaguuuucaacugaacaccgcugauaugaaugaaauauccgagcuuuugcuggacaacucuaagacucgucuagaucgccagagagaaagccucaaaaagcuggcaaagaagguggacgauauuuccgucgccaaaaagcaccagaaaaucgcuacagaguucucaaaggccauucuuggaaauaaggcgaaauucgacgugauccugaacguaaccacggauaguagcaaugacuggucuuuuaaguuggaagaugaggacgcagaugagaaaaucguugugcuccuggaagaguuaaacacuccccagcaagaagcccugaacauuauacaucagugguauucccagaucucacucaauggcauugucccugacggcaagagcaucagugaggcuaugauaucuuccuacgaacuucacaaagagcaccuggccuugcuaaagcagcaaauuaacaauaccaaggacaaaaagaaagcacaugggcugcacgaggcuuauaacgaauacgugcauggaaauaacaauaagaaacucaaccaggccgauuucuauagcaaggugaagcagaaucuggagucgucucuuaucacagacgaaauccuggaguugauuaacgcggaaaauuuuaugccaaaacaaaggacuuccgccaacggugucaucccccaccagcuccaccagcaggagcuggaucggauuauacaaaaucaggcaaaguacuacccuuucuuagcugagaccaacccaaaugaaaaacgaucaaagguugccaaauauaagcuggacgagcuaguggcuuuucgcguacccuacuaugugggcccucucaucacagccaccgaucagaagaaaacgagugggaaggaauuugcauggauggucagaaaacagccaggaaggauuacuccguggaacuuugacgagaaggugaacaaaauggagagcgccaauacauucauccggcgcaugaccacuaaggauuccuaccugaucgcugaagacguucuucccgaugagucuuugcuguaucaaaaauuuaaggugcucaacgaacugaauaaccuuagagcggacggcaggaagcugaaagucagcgugaagcagaaaguauucaaggaguuguuucagcagcagaaaacaauuaccauaguuaagcuccaaaauuaccugaaggcagaaugcucauucuuaacgaccccugagaucaguggucuguccaaaccagagcauuuugugagcucucuagccacauauauugaucucaagaaaaucuucggggaagacauugauaaccccgcucgucagaaugacuucgagcggaugaucgaaugggccacuauauuugaggacaagaacaucuacucagaaaaacugaaugagauuaaguggcuuaacgaucgacagaagaaagaguugaagaauaaaaacuaccacggauggggcaagcugagugcaaaacuccugaagggcuuaagagacagcgaugaauguuccaucauugagcauauguggaauacccaacagaacuucaugcagguccaagccgaagaggacuuugcucagaggauccaggaagagaauaaccagcaccugaaggggaacacacuugaggaaguguuggccgaugcauauacuucuccucaaaauaaaaaggcgauacgccaggucgugaaaguuauugaggacauccagaaggcuaugggagguauugccccacagaaaaucucgauagaguucacccgggcacccgaagagaagccgagaaggagcguggaacgccaacagcagaucgagaaaauuuacaaguccguagccaacgaagucgagaaugcuggcgugaaggaugaacuccagcgauuuucagaccggaaacaaacacugaccgauaaguauuuccuauacuuuacucagcuggggaaagacauguauacgggaaagaguaucaacauugaucagaucggcaauuaccaaauagaccauauucucccucaggccuucaucaaagaugacucucuggacaaccguguucuugugagcgcagcugucaauaacgguaaguccgauaaugugcccacaaagaacgacagauauaaaguaagggagcacgggcagcgcuuguacgaucagggccugaucucaaagcggaaauuuaauaacuuaauuaccgacccagauagcaucaauaaguucacugccagaggauuugugaaaaggcaacucguugagaccucucaggucauucgacugguggcggaguuccuuuacaacaaguaucaguccaagagugaaauaaucgaagugcgcgccaaaaugaauagccagcugcggaaggacuuuggcuugauuaaaaacagaaacgucaaugauuaccaccaugcucucgacgcauaucugacaaccuucaucgggaacuaccuauauaggcguuacccuaagcugcgcgccuauuucacuuacggaugcuuuaaaaagguugaugacucucaacucaaguacuucaauuuucugcacgauauugaggacgacaaaaagaaaaucauaaaggauaacgacacaggugaaauccuuuggcaucgggaugagggcauugcuagauucaaaaggaucuauaauuuuaaguacauguuggugacgcacgaggugcugacccgacagggggccauguucaagcagacuguauauuccgcagcggucgccggaaguaaaaaguuaauucccgugaaagaagaccggccaaucgauauauacggcgguuauacaaacaauaacgacgcuuuucucgccauuguuaaggugaccaaaaagaaacaguacauggucguggggaucccccaacgcgcaguugugaagcugaaugaugcugccaagcagggcucaaaagcauaucagaagguacuuuacaacgucaucaaaccucaguucauuaagaaaaagaaggacagaaaaacaggaaagauaacucaaaaacuggagaauuuugaaaucguggugagcaagacccuauacaggcagcucauuaucgauggcgaccagaaauauaugcuggggucguccgccuacaaguauaacgcuaagcaauugguccugucugaguacgcguuagaaguucucgaucggagcauuuucgagaaaaaggaguauacgaccguggaccuggauaauguauacgacgaaauccuugcccagguggacaaauauuuuucacuguacgauaagaacaaauuccgacagaaguugcacgagaguagaaagauauucacagaacucccaaucaauaaccuguuuuccggaacuaaacuacugaagucugguaaacgcgagacccuuaaugagauucucgaaggccugcaugcaaacgcuacaaagaaagacuugaaaagccugaaauucuccacuccguuagggaugauccaguaccccucaggaauuauccucagcgagaacgccauacuguguuaucaaaguccuaccggcauuuuugaaaggcgugucacgcuuaaggaucuguga

SEQ ID NO: 3078 - RNA, 4092 nt, Artificial Sequence
  Cas9 variant
augaccaagcugggcaaacccuacgggaucggaguggacauugguagcaacuccauaggcuucgccgcugucgaugaaaauucucaccucaucagacuuaaggggaaaacaguuauuggagcaaggcuguuugaagagggcaaggccgcggcugaccggcgcgccucacgaacuacgcguagaagguugagucggaaccgcuggagacugagcuucuuaagggacuuuuucgaaucccauaucaccccuacagauccaaacuuuuucaugcggcagaaauauucugagauuucgccgaaggauaagucacgcuacaaauaugaaaagcgacuauuuaaugacagaacugaugcagaguucuacaaauaugagaauugccccaccauguaccaccucaggaaccggcugaugacagacccuagcaaggccgaugugcgugaaaucuauuuugcuauacaucacauccuuaaaagucgcggucauuuccugaccccaggggacgcaaaggauuuuaauacuaacaagguagccgugaauaaaauuuuccccgcuuugcaagacgccuacgcgcaggucuacccugaucucgacaucacauuugacgagaacaaggugaaugaguucaaaaccguucugcugaacgagaaggcaacgccauccgauacucagagagcccucgugaauuuacugcuugcuaaagagggagacagggauauuuugaagcagcaaaaacaggcccugaccgaguucgcaaaggcugucgugggccuaaagacaaaacucaacguagcccugggcacugaaguugacucuagcgaagcgaccgccuggaauuuuucccuugggcagcuggaugacaaguggacaggaaucgagucagcaaugaccgaugaagguacggagauauuggaccagauucgggaucucuaucgagcucgccuguuaaacggcaucgugcccgccgggaaaacucugagucaagcuaaggucgacgauuacgcccagcaccacgaggaccucgaacuuuucaaagacuaucugaagcaguuggaggaugacggaacagcaaaggccauuagacagcuauacgauagguauaucgacggcgaugacgcuaaaccuuuugugcgggaagauuucgugaaggcgcugaccaaagaggucacugcacauccaaacgccaagagcccggaacuccuggagcgccuugcucaacccgacuuuaugcugaaacagagaaauaaggccaacggugcaaucccuguucagaugcaacagagggaguuggaucagauuauaaagaaucagucuguguacuaugacuggcucgccgcuccaaaccccguagaaaaacaccguaaguccaugccuuaccaacuggaugaguuacugaauuuccggaucccauacuauguggggccccuagucacagccaaagaacagaaggcagcgcagggaggcguguuugcuuggaugguucgaaaagacccggauggcaacauuaccccuuacaauuucgacgagaagguggacagagaagccucagcaaacacguuuauccagaggaugaagaccacagauacuuaucucauaggggaggacguccugcccaaacaaagccuuuuguaccagcgcuaugaggugcugaaugaacucaacaauguacggguuaacaaugagaagcugaguauugaacagaaacagcaagugaucagagagcuuuucgagaggcauaacucugucaccaucaagcaguuugccgaaaaucugcgcgcucacggagauuacgcccacaugccagagauucgagguuuggcagacgaaaaacgguuccucuccagccugucgacauaucgucaguuaaagucucugcuaccugaggcuaucgaugaccccgccaaacaggcggauauugaaaacauaaucgccugguccacuguguuugaggacgcugcaauuuucaagaccaagcucaaagagaucaacuggcuggauucacaaacaaucaccaaacuuaguaauauuagauacaggggcugggggcaguucagccauaaauuuuugaacggacugacucucggcaauggucacacgauaauccaggaacuguucuuauccaacaauaaccugaugcaaauucuuacagacgagaccuugcagaagaaaaugacugaacucaaugccgauaagcugaaggcugccaacaucaaugacgcaauugaugacgucuacaccucuccaagcaacaaaaaggcgcuacgccaggugcugcggguuaucgaggacauaaaaagagccgcugaugggcaggaccccucauggcucuauguggaaacagccgauggcggaggcaccccugggaagaggacucgagcacgccaacaucagcugcaggagaucuacgcuaaugccgcacacgagcuuauugacagugccguacggggagaauuggaggauaaaaucgcugacaaggcggauuuuaacgacagacuggucuuauauuucaugcaggguggcagggauauuuacacagggacgccacucaauaucgaccaacuguccagcuaugauauagaccauauucuuccgcagucucugaucaaggacaacucauuggauaaucgugugcucguucacgccauuaucaaccgcgaaaagaacgcaaccuuugcuaguacuauauacgcccagaagaugaaugccacauggcggcaguggcacgaggcuggacugaucagcggcagaaaacuaaggaaccugcaaaugcgacccgaccagauugauaaguaugcauccgguuucguggcccggcagcucgucgaaacccgccaaaucauuaaacugacagagcagaucguggcggcucaguacccugagacuaagauaauugccguaaaggcagggcuuucucaucaguugagagaggaacuggaauuucccaaaaauagggacgugaaccacuaccaucacgccuucgaugcauuuuuagcugcccggaucggcaccuaucuccugaagcgauucccaaaucuucaagcguuuuucacguacggaaaauuuaagaaagcugacguuaagaaacugagaggcuucaacuucauccgcgauauuacccacgccgaggacaagaucgucgugaaggauacaggggaggugauuugggacaaaaagagggaugucgacgaacuagaucguauauauaauuuuaaacggaugcucaucacucaugagguucacuucgaaaaggcagaccuguuuaaacagaccguguacggagccaaggacucgaaggaggcugguggcaaaaagcaguugauuagcaaaaagaaaggguauccuguggauaucuacggaggcuauacacaggaaacugguuccuaccugucaguagucagauuaaccaagaaggccauguacgcagugguuaaagugaguacgagggacgcugccaagcucgcggucgccaaaucuauuagcgagcaaaaggagaacgaaacacugaaugauaucauagacgagaaacuuuccaagaucucaaagaacgggaaaauuacccaugaacuguucgaggugguuuugccacgcgugggccagaagacucucuuuaaaaauagcaaguauaaccuguuccuaguaaauucugauacauacaugcacaacuaucaggaacuguggaugccccgagaguaccagaaaauguggaaggacaucucccuuaguaaguauggagaugcacaaaccgaggaccagcucgaucagauuuuuggcuucaucgucagccaggucaauucuuacuuuaaccuguaugacauaaaccaauuccggaaaaaguugaaugaugcugccgacaaauuugcuacucugccgaugagagauaccgacgacaugcaggggaagauugcaacaaucggacaguuacucaucggccugcaagccaacgccgcuagguccgaucuucgcaaucuggacauuaaaacgccuuugggucuccugcagauaccaaacgggaucucacuagauagugacaccagcgugguguaccagucgcccacuggacugcuugaacgugagguucaucucuccgaucuguga

SEQ ID NO: 3079 - RNA, 4092 nt, Artificial Sequence
  Cas9 variant
augaccaagcugaaccagcccuacggcaucgggcucgacauuggaagcaauuccauagguuucgccguggucgaugcuaacucucaccuucugagauugaaaggcgagacagcaaucggggccagguuauuucgggaaggacaaucagcggcugaccgccgagagagucguacuacgagaaggcggcugagccgcaccagauggaggcuauccuuccuccgggauuucuucgccccucauauuacaaagaucgacccagacuuuuuccugcgccagaaauauucugaaauuucgccgaaggauaaagaucgauuuaaguacgagaagagacuuuucaaugacaggacugaugcagaauuuuaugaggccuaccccucaauguaucaucugcgguugcgucucaugaccgacgcuagccaggcagauccucgcgagaucuuccuggccauacaccacauccugaaaaguagaggccauuuucucacaccaggugcugccaaggacuucaacaccgaugaaguugacuuaaaacacauuuuucccgcgcuggcagaggccuacgcucagguguauccugaccuugaauugaauuucgauuccgcccuggcagacgauuucaaggcuaaacuacucgacgaggaugccaagccaucugacauccaaaaggcgcugguaaaccuucuguugagcuccgauggggagaaagaaauugugaagaaaaggaagcagguccucacugaguuugccaaagcaaucacaggacugaagaccaaauucaauuuagcucugggcacggaaguggacgaggccgaugcuucaaacuggcaguuuaguaugggccagcucgacgauaaguggagcaauauagaaacuucuaugaccgaccaagggacagagauuuucgagcagauccaggaacuuuaccgggcccgacuguugaacggaauuguucccgcagguaugucccuaucacaggccaagguggcugacuacggccaacacaaagaggaucuggaacucuuuaagacuuauaucaaaaagcugaaugaccaugagcuugcgaaaaccauccgcgggcuguacgauagauauauuaacggagacgaugcaaagccuuucuugagggaagacuuugucaaggcccucacaaaagaggugaccgcucacccaaaugagguaagcgaacagcuguuaaaccggaugggccaggccaauuucaugcugaagcaacgcacgaaagcaaacggugccauaccgguucagcuacagcagagagagcucgaucaaaucauugcuaaccagaguaaguacuaugacuggcuggccaaacccaauccuguggaaaagcauagggcaucuaagccauaccagcuugaugaguugcugacuuuucguauccccuauuacgucgggccucucauaacaccaaaacagcaagcggaauccggagagaacguguucgcuuggauggugcggaagaaucccagcggcaacauuaccccguacaauuuugacgagaaagucgaucgagaagccucggcaaacacuuucauccagagaaugaagacaaccgacacguaucugaucgaugaggacguucuuccuaaacagucucuguuguaccagaaguaugaagugcucaaugagcugaacaauguaaggauuaacaaugaggccuuauccaccgaccaaaagcagcgccugauccgggaaguguuugagagacacucaagugucacaauuaaacagguggcugauaaccuaguugcccacggcgacuucgcacagaggcccgaaauacgcgggcucgcugaugagaagcgauuccugagcucccuuucuacuuaccaucaauugaaagaaauccugcacggagccauugacgauccaaccaagcuccaugacaucgagaauaucauuacauggagcacuguguuugaggaugcggccauauucaaaaccaagcuggcugaaaucgacugguuagauccugcaacaauuaaaaagcugucaaacauccgguaucgugguuggggccaguuuaguagaaaacuuuuggacgggcucaaacugggaaauggccacaccgucauucaggagcuaaugcuguccaaccauaaccucaugcaaauccuggccgaugaaacucuuaaggagacgaugacagaauugaaucaggacaaacugaagaccgaugacauagaggacgugaucaacgaugcuuacacuagccccucuaauaaaaaggccuuaaggcagguacuccgcguuguggaggacauuaagcacgcagcgaacggucaggauccaucauggcuguauaucgaaaccgccgacgggcccggcacagcuggaaaacggacccaaaguagacagaagcagauucagacugucuacgccaaugcagcucaagagcuuaucgauagcgccgugaggggcgaacuggaggacaaaauagcagauaaggccuccuucacagaccgauugguccucuacuuuaugcaagggggacgcgauauuuauacgggugcuccucugaacaucgaccagcuaucucacuacgauauugaccauauccugccacagucgcucauaaaagacgauagccuggacaaucgggugcuuguuaacgcgaccaucaauagagaaaagaacaauguguucgccuccacuuuguuugcaggcaagaugaaagcuacauggaggaaguggcacgaggccgggcugauuucaggacguaaauuacgcaaccucaugcugcggccggaugagaucgacaaguucgccaaaggcuuuguagcuagacagcuugucgaaaccaggcagauuaucaagcugacagagcagauagcagccgcgcaauaucccaauacuaagauuaucgcugugaaagccggucuaagucaucagcuccgagaagaacuggauuucccuaagaaccgggacguuaaucacuaccaccaugcauuugaugccuucuuggcugcacgcaucgggaccuaucuguuaaaaagauacccaaagcucacgcccuuuuucaccuauggcgaguucgccaaaguggacgucaagaaauuuagggaauuuaacuuuauuggagcgcugacacacgcuaagaagaacaucauugccaaagauacuggcgagauagugugggacaaggaacgggauauccaggagcuugaccgaauuuacaauuucaaaagaaugcugaucacccaugaaguacacuuugauauggcagacuuguucgaccagacaauuuacgccgcuaaggauucuaaagagcgcgggggaagcaagaaccucauccaaaagaaacaggguuaucugacuggcauauacgggggauauuccaccgagaggggcucauacgugagcaucauucguacguuuaagaaaggugccccuaucuauaauauuguuaacaucucuacagcagacgucucccuacugagugauaagcagcgggugagcgaggcuucugccgacgugcuucucaaagagcugauaaagaagaaauuggcgaagagaaaauccggggaaaauaccaagucaggcgccuucgagauuguccugccaaggguuggaaagaacacuuuauuuaagaauaagaaauacggccucuuccugguggaaaguacaaccgaguuucauaacuaucaggagcuuuggcugccccgcaaugaucaaauguugaucaagagcauccagucgcacaaaauugaagaguccaaggcagacuacgaacucacucgaauguacagaaacauagcuucucagguggaucacuauuucgggcuguacaccauccggaaauucagcgagaagcuaacagccucaauuaaugacuauggagcucugccgguauacaagagugaaacgaccgauggcaaauaugagguccuuuccaaccucuuugagggucuggggucuggaacuagcacaggcaauuugaccgcagugaaguuacagccuaacuucgguaggguuuaccugacauccggcaucgugcucgaagacgauacuucaauuaucuaucaaagcccaaccgggcuguuugagcgcagugucaaacuugccgaccuguga

SEQ ID NO: 3080 - RNA, 4092 nt, Artificial Sequence
  Cas9 variant
augaccaagcugaaccagcccuacggcaucgggcucgacauuggaagcaauuccauagguuucgccguggucgaugcuaacucucaccuucugagauugaaaggcgagacagcaaucggggccagguuauuucgggaaggacaaucagcggcugaccgccgaggcagucguacuacgagaaggcggcugagccgcaccagauggaggcuauccuuccuccgggacuuuuucgccccucauauuacaaagaucgauccagacuuuuuccugcgccagaaauauucugagauuucgccgaaggauaaagaucgauuuaaguacgaaaagagacuuuucaaugacaggacugaugcagaguuuuaugaagacuaccccucaauguaucaucugcgguugcaccucaugacccacacacauaaagccgauccucgugagaucuuccuggcuauacaccacauccugaaaagccgcggucauuuucucaccccaggggcagccaaagacuucaacacugauaagguugacuuagaggacauuuuucccgcucugacagaagccuacgcccagguguauccugaucuugaguugaccuucgaccuggcaaaagccgaugacuucaaggcuaagcuacucgaugaacaggccacgccaagugacacucaaaaagcacugguaaaucuucuguuguccucugauggagagaaggagaucgugaaaaagagaaaacagguccucaccgaauuugcuaaggccauuacaggccugaaaacuaaguucaacuuagcgcugggcaccgagguggacgaagccgaugcaagcaauuggcaguuuuccauggggcagcucgacgauaaguggucaaacaucgagacaaguaugaccgaccaaggaacggaaauauucgagcagauucaggagcuuuacagggcucggcuguugaaugguaucguucccgccggcaugagccuaucucaggcuaaaguggccgacuacgggcaacacaaggaagaucuggagcucuuuaaaacuuaucugaagaaacuuaacgaccaugaacuggcaaagacaauucgaggauuguacgaucgcuauaucaauggcgacgaugccaagccuuuccucagagaggacuuugucaaagcucugaccaaggaagugacugcgcacccaaacgagguauccgagcaguuacugaauaggaugggucaggcaaacuucaugcuaaaacaacggacaaaggccaauggggcuaucccgauucagcuccagcagcgcgaacuggaucaaauaaucgccaaccagucaaaauacuaugacuggcuugcagcccccaacccuguugaggcucacagauggaagaugccauaccaguuggaugaacugcucaauuuucauauucccuauuacgugggaccucugaucaccccaaagcagcaagccgagagcggcgaaaacgucuucgcauggauggugaggaaagaccccaguggcaauauaacgccguacaacuuugaugagaagguggaccgugaggcgucugcuaauaccuucauucagcggaugaaaacaacugauaccuaucuuaucggggaagacguccugccuaagcaguccuugcucuaccagaaauaugagguucugaacgaauuaaauaacgugcgaaucaauaacgagugccugggaacagaccaaaagcagagacuaauuagggagguauuugaacgccacagcucggugacuaucaagcaggucgccgauaaucucguggcacauggugacuucgcccggagacccgagauuaggggccuggcugaugaaaaacgcuuccuuucuuccuugucaaccuaccaccagcugaaggagauacuccaugaagccaucgacgauccaacaaaacuguuagacauugagaacaucaucaccuggaguacuguuuuugaggaucacacgauuuucgaaacaaagcuggcagagauagaauggcuugacccuaaaaagaucaaugaguugagcgggauucgauaucggggauggggccaauuuucccguaaacuccuggauggucuaaagcuggggaacggccacaccgugauccaggaacucaugcugucuaaucauaaccuuaugcagauuuuggcugacgagacucugaaggagaccaugacagaauuaaaccaagauaaacucaagaccgacgauaucgaggacgucauaaaugacgccuacacuagccccucaaacaaaaaggcgcugagacaggugcuuaggguaguugaagauaucaaacacgccgcuaauggacaggacccaaguuggcuguucauugagacagcagauggcacggggaccgccggaaagcgcacucagucccggcaaaagcagauccagacaguguaugcuaacgccgcacaggaauugauugacagcgcggucagaggugagcucgaggauaaaaucgccgacaaggcuucuuuuaccgauaggcuggugcuauacuucaugcaaggcgggcgagacauauacacaggagcgccccugaauauugaucagcucucacauuaugacaucgaucacauucugccucagagucuuaucaaagacgacagcuuggauaaccgcguccuggugaaugcaacuauaaaccgggaaaagaauaacguuuuugcuuccaccuuauucgccggcaaaaugaaggcaacguggagaaaguggcacgaggccggucucaucucugggaggaaacugcguaaucuuaugcugcgcccagacgaaauugauaaguuugcuaaaggcuucguggcgcggcagcuaguagagaccagacaaaucauuaagcucacagagcagaucgccgcagcucaguacccgaacacuaaaauaauugccgucaaggccggacugucgcaucaauugagggaggaacuggacuuucccaagaaucgagaugugaaccacuaucaucacgcuuucgacgcauuuuuagccgcgcggaucggcaccuaccuccugaaacgcuauccuaaacuugcuccauucuucacauacggggaauuugccaaaguugaugugaagaaauucagagaguuuaauuucaucggagcacugacucaugccaagaaaaacauuaucgcuaaggacaccggugaaauugucugggauaaggagagggacauacgggaguuggaucgaaucuauaacuuuaaaagaaugcucauuacgcacgaaguguacuucgagacagcagaccuguuuaagcagaccaucuacgccgcgaaagauagcaaggaacgcggcggguccaaacagcuaauucccaagaagcagggauauccuacucaaguauacggcgguuauacacaggagucagggaguuacaaugcucuggugaggguugccgaagcagacaccacugccuaucaggucaucaaaauaucugcucagaacgccagcaagaucgcauccgcuaaucuuaaaucacgugagaagggcaaacaacuccugaacgagauuguggugaagcaguuggccaagcggagaaagaauuggaagccaagcgcgaacucuuucaaaaucgucauucccagguuuggaaugggcacccuguuccagaaugccaaguacggguuauuuaugguuaacuccgacacauauuaccgcaauuaccaggaacucuggcugagucgagagaaccaaaaacuucugaagaaguuguucagcaucaaauaugaaaagacgcagaugaaucacgaugcacuccagguguacaaagcuauaauugaccagguggagaaguucuuuaaacuguaugauaucaaccaauucagagccaagcuaucugacgcuaucgaacgguuugagaagcugccgauuaauaccgauggaaacaaaauaggcaagacugagacacuuaggcagauccucauuggucugcaggcaaaugggacccgcuccaacguaaagaacuugggaaucaagacagacuuaggccugcuccaagucgguucaggcauuaaacuggauaaggacacucagaucguguaccagaguccuagcgggcuuuucaaacguagaauaccacuggccgauuuguga

SEQ ID NO: 3081 - RNA, 4095 nt, Artificial Sequence
  Cas9 variant
augggcgacagaaaguacaaccuggggcucgauaucggaaccagcuccauugguuucgccgcuguggacgagaauaaccagcccauaagggucaaaggcaagacagcaaucgggguucggcuuuuugaagagggaaaaacugccgcggaucgccgaggcuuccguacgaccagaaggcggcugucucgcagaagguggcggauuaauuuguuaaacgaaaucuuugacgcucaccuggccgagguggauccuacauuccuagcacgccucaaggaaucaaaucgaaguaaccuggaccccaaaaagagcuuucaagguucccuucuguucccggagagaaaggauuaucaguuuuacgaggaauaucccacuauuuaccauuugaggaaagcccucauggagaaggaccggaaauucgauuuucgugaaaucuaucuggcuguacaccauauaaucaaguaccgcgggaauuuccugaacggaaccccuaugagaucuuuuaaaguggagaauauugagcucgacacauuauucgaucagcugaaccagcuuuaugcagaaaucgucccagacaaugaguuggccuuugaucuggcucaaguggccgacguuaaggacgugcuaucgucaaccacuauuuacaagauggauaaaaagaaacagcucgucaagaugaugcugcuucccgcgagcaacaaagcacugcagagugaaaauaagaaaaucgugacacaguucguaaacgccauauugaauuacaaguucaagcucgacguucuguuacaaguggagaccgaugcugacuggucccugaaacucaacgaugaaggcgccgacgauaaacuugaggaguuuacgggcgaccuggaugaaaacagguuggagauuaucgaccuacugcagcggcuccacaauugguucucucugaacgaaauuacuaaagaugggaauagccuuuccgcagcuauggucgagaaguaugaaaaccaucaccaccaucugggauugcucaaaaaggugaucgagaaucacccugacgccaagaaagcgaaggcccugaaagagaccuacacagcauauguggguaagacugacgauaaaacccagaaccaggacgauuuuuacaaggcugucgaaaagaauuuagacgauucaccagacgccaaagagaucaagcgacugauucaacuagaucaguucaugcccaaacagcgcacaggccaaaacggggcuauaccucaucagcuccaccagcaggaacuggaccaaaucauugagaagcagaguaaauauuacccauuucuugccgaaccgaaucccaacguuaagagaaggaaggaugcaccuuauaaauuggacgagcugaucgccuucaagauaccauacuacgugggaccccucguaaccccugaggaacaggcucagaauggcgagaacguguuugcguggaugaaacggaaggcagccgguccaauuacgcccuggaauuucgaugaaaaagucgaccgcauggagagcgcuaacagauuuaucaggcguaugacuacaaaggauaccuaucuguucggggaggacgugcuuccggccgaaucuaugaucuaccaaaaauuuguugugcugaaugaguugaacaaccucaagauuaauggacggcaccuguccuuaaaggacaaacaggaugucuauaacgaccuguucaagcagcagaaaacugugucaaucaaggcacuacaaaauuacuauguaacaaagaagaaggccgcuaccgccccuacgguuggcggccucgcagaucccaaaaaguuucugagcagucuuucuaccuacauugacuucaaaaacauguucggggaacgagugaaugauccacaguuucaggaggacuuggaacagauagucgagugguccacaaucuucgaggauagaggaauuuuuaaggcgaaacugcaagcucucgguuggcugagcgaaaagcagauccagcaauuaguggccaagagguauaaaggcugggggcgccugucgaagaaacuuuugacuggacucaagaacgcagagggcuacucuauccuggacgaaauguggcgguccaccgguaauuucaugcagauucagucaagaccugaguuugccgcucuaauacagcaagccaacgaaaaacaguucgaggggaaugaucccgacaacgucugggagaauaucgaaaacauucugggcgaugcauacacaaguccacagaauaagaaggcuauccgccaggugguuaaagugguacaagacauugagaaggccgucggaaacccaccugaaaagaucgcgauagaguuuacuagggaagccgcugcaaauccacagcgaacccagagccggcuccguacacuggagaaacuuuaugaguccgccgaagaggugguugaugcuggcuugaccgccgaacuggcagaguucaaagagaacaagcauguguuaucugacaaauacuaucucuacuuuacucagcuggggagagacgucuauacgggagauacaaucagccuugacaagcugaacgauuacgacguggaucacauuuugccgcaaucauucaucaaggacgauagucucgacaauaggguacugaccauucgcgcggugaacaaugguaaauccgauaacguucccgccaagauguuuggcaaaaagauggggagcuucuggcgguaucuacuggacaauggaaugaucucuaaaagaaaguacaacaaucucauaacugauccugacaacauuucaaaguacgcucagaaaggcuuuaucaauaggcagcuggucgaaaccagucaagugauuaaacuuacagccaacaucuugaaugguauauaugacaaggauaccgagaucauugaagugccagcaaagaugaacagccagaugcgaaaaauguucgaccuggucaagguucgcgaggugaaugauuaccaucacgcuuucgacgccuauuuaacuaucuuuauugggaacuaccucuauaagugcuaccccaaacugcagccuuauuucguguacgauaauuuuaagaaauucggcaacaaggaagacaucggacauaaacgguuuaacuuccuuggcaagauagagagagagaagaaaguagucgcaccagaaacaggggagauucugugguccaauguggcccccaacgaaacgaucaagcagaucaaaaagguuuacgauuauaaauuuaugauugugucuagggagaucaccacucgucgcgcugaacuauucaaucaaacagucuacccgaagaacuaucacggaaagcucauuccuauaaaagaggaccggccaaccgaucuguacgguggcuauucggggaauacagacgcguacuuggccaucguggcacuggaggauaagaaaaagggaaaauauuuuaagguugugggcauucccacuagaguagcugccaaauuagaaaagcucaagcagcaggacagccagcaauaccugcaggcccuucacaaagucaucgcuccucaguucaccaaguccacgaaaaaggguauuaaaaagaccgaguuugaaaucgugcuggauaaggugcauuacaggcaguugguccaagacgggcccguuaaaaugaugcucggcucaaguacauauaaguacaacgcaaaacagcuggugcuaucugagaaggcccugcagguaauagcggacgaucgaaaauucgacgaaacucagaaggaugacaaucuuaucgcuguguaugaugagauucucagcaucgucaaccaauccuucgaccuguacgauauuaauggauuucggaagaaauugaacgacaaucgcgaucaguucaucgaccugccagccgagaccaaguaugaaggcagaaaagugguugcacacgggaagagggagaugauauuagaaauucucaaaggacugcaugccaacgcugcauuuggcaaucuuaagccuaucgguuucucaacagccuuugggcagcugcaagugcccaacggaaucauuuugagcaagaaugcgauacucauccaccagucuccauccggccuguucgagcggaaaauuaagcuaagugaucuguga

SEQ ID NO: 3082 - RNA, 4095 nt, Artificial Sequence
  Cas9 variant
auggagaagcaggaauacuaucugggccucgacauggggaucagcuccgugggaugggccgucaccaacgauaaauacgagcuucugagaaagaaagguaaggacauguggggcauuagggaguucgaggaagcugauucuucagcagagcggcgcacacaccgaguuaaucguagaaggcggcaacgccagguggccagaaugggguuguuaaaagaguauuuuagugacgcgauagaaaagguagauagcaacuucuuuaucaggauugaaaauuccaaguacuucuuugaagacaaagauggacggcugucuucgaagaacggcaucuucgacgaugcugacuauaaagauguggacuacuauacugaguaccccacgauuuuucaucuacgcaaggcccuccuggauaucgaggacaccgguaaagaauacgacguccgacuuguguaucuggcauugguuaauauguucaagcacagagggcauuuucuccugaacacagagggagaugcccugucaagcgaacaggugaauacuaccuaccaggagcucuuagaaauacuggagaacaauuaugacaucagucuugaguccagggauauuaaggacgucaucgauauuaucucuagcuccgacaacggccggaaaaagaaacacgaacaaauauuggagcuguucggcgugaagaaaucagauaagcgugcuaaugaacuacucaaaugccugugugggcuuaguguaaacgcaaagcugauuuuugacgagaauuacgaagagaagguugauuugugcuuccaugacuuuagcuauacagauaaaaucccugaccucauggagaagcugucugaagaggaauacuauguggucgagcaguuaaaauccauuuacgacuacucaauccuggccggaacccucaaggguuaugauuaccuuagcugugcucgcguggaacuguaugagaaacacagagaggacuugaagcuacugaaggcccucuacaggcgguauaaaacuaacgaagaguacaaugauauguucaagagugacaaagaaggcacauauucugcguacgugaacuccuucaacagcucggauucuuccgucaagaucaaaaaguaccgauggaauaugaaggggcgcaccauugacaaccuguauggaacgaucaaaaaggcauuuaaagauaauacugacgauaaggacguucagucaaugauggagaguauagauaaagagcaguuccuuccaaagcaacugaccggcgccaacggugugauuccgaaucagguacacaagaaagaaauggagagaaucuugaagaaagcucagaacuaccuccccuuucugaaggaaaaagacgagagcgaauuaacaguguccgagaggauacugcggcuauucacuuuucagauuccuuauuacgucgggccacucggagaaaauucuaagaccggcugggugguucgcagagaaggcgggagggugcugcccuggaacaucgaugagaaaaucgacaugagcgccacaucagaagcauucauuggaaaucuuauccguaagugcaccuauuugagugacgagaaggucaugccuaaggcuucccugagcuacgaacgguauugugugcucaacgagauuaauaacauaugcaucgauggugagcgacuggacacggaacuuaaacagaaaauuuacacugaguguuuuaugaagggcaaaagaguaacaaggaagcaaaucugcaauuaccugguugcccagggguguaucaagucugaugaacaagugaccggaauugacauaaacgucaauucaaguuugagcuccuauggcaaaauguucgcgaucuuuggugagcaucucaaggaagaugccauucgcaaaguggcagaggagaucauuuacugggggacuaucuucucugacucgaagaaaauguuucggaagcaccugacaaaguaugucgaacagggcauauuaggagagagccaggugaaaagaauccugggcuacaaguucaaagauugggggagguuuuccaaggcucuacucacccugcagggaauugacaaaucaacgggugaacuuuugagucuggagaacgccaugugggaguauucucucaacuucauggaacugaucaauagcgaugacuucaccuuuaaggaugaguuagcuaaccgccgaacauccgccauuaagucacugagcgaguucacuuacgaggaccuugaagauaccuauuuuucuguuccagugaaacggaugaucuggcaaacaauauugguaguccgugagauugagcagaucaugggcuacgcacccaagaaaguguucguugaaauggccagauccgaggaagagaagggggacaaaggaaggaaggacagucgcggcacucagcuccuggaacuauacaaaaauauuaagaacaccgagaaucaugauuggaagaaagagaucagcgaagcuaacgagucugguaagcugcgguccaaaaagcucuaucuguacuauacacagauggggagagacauguacaccggcgaagagauaaauaucgauaugcuuuaugacgauucaauguacgacauugaucacaucuauccuaggcacuacgugaaagacgauaguauugucaacaauuuggugcugguaaaccgacgcgcgaaucaagacaucaagaaggauuuauacccaauaccggacaaaauuaucagcaaccccaaggugcaggaacucuggaaaaugcugcauaagcagaaucuuaucacugacgagaaauauaagcggcugaugucgagauccccuuuuacggagaagcaguugggagauuucauugcaaggcaacucguugaaacacgucagggcaccaaagggaucgccgagcugcuaggacagcuguuuaaggacacugaaauugucuacgcuaaagccaccaacgugucugauuuccgccgggacaaugguuuugucaagagcagacucgugaacgauuuccaccaugcacaggacgccuaucugaacauaguugugggcaauguguacuauacaaaauuuaccaagaacccauggaauuucaucaagaaagauuuugacaaggauaggaacaaaaauggguacaaccuugcuaagauguucgaccgagauguaguccggggagacgauacugccuggauugcaaguaaaaaggacacacaaggcacgaucgagaccgugcgcaagaugaugaggaaaaauacucccuugaugacaagaaugucauucgagcagcacggugggauugcgaacgcuacccuguauuccgccaagaaagcaaagguugaaaauuacaucccuuuaaaaucuagcgacauacggcucuccgaugugaagaaauacggcggauuuacaucagccacugucgcuuauuacuucaucgugcaucacaaggagggcaagaaagaaaacaccacgauugaggcccugccacuuuauugcaagcgaaaaguugaaaaugaggagaacgggcugcuaaaguacugugaagaggugcucggauauggcgacguaaaaauccuguuuaauaaguugaagauucagagccuguuagauaucaacgguuaccaagcacaccucagugggaaaaccggaaaucagcugacacuuagaaacgcuaugaaccugugcguccccgaaaaguggacugccuauauuaaaaaguuggagaaacucguggugggccaugucaaggaacaggagauaucuuccgaggcgaauaucgaacuguacgaccuacugaccgauaagcaccuuaacagcguuuacgccaaacgcccgaaugcuuauggucagaagcucaucgacaacaggucgcguuucgugaaucugaaaccugagucacaaugcgaagcaauuuugcagauacugaaguuaacaaaaaucggcaacaaugagacuaaccucaagcugauuggggaaucugagcauaguggaaagaugcuuaucuccaaaaaucugaaggauaccgacaaacccgccauuaucugucagagcguaacgggcuuguacgagcggaagauauauaucuuugaugaacagcucgacaaauga

SEQ ID NO: 3083 - RNA, 4095 nt, Artificial Sequence
  Cas9 variant
augaacaagagauacaauaucggccuggacauugggaccaacagcauaggaugguccguggucaaugaucagucucaacucguuaggaucaaagguaaacuuggcuauggggugcggcuguacgacgagggacagacagccgaagaucgccgauuguuccguacuacgagaaggcgguuaaaacgcagaaaguggaggcugggccuacuccgggagauuuuugaacccuauaucaccccucaggacgcuacauucuuucugcgccagaaacaaucaaaccuuaguccaaaggaucugcagaagcagcagccgcaaauugguuuguucaaugaccgacucgauagcgacuuucacuaccaguaucccacuaucuaccaucugagauaugcacugaugaccgagaaaaggcaguucgaucuccgggaaauauacuuagccaugcaccauaucguaaaguaccgugggcacuuucugaacgcggcugccgcauccucuuucaaaucgggagagauugaccuugccaaggauuuugcugcauugaaucagaucuucggcacaaucuuuucagaggugggcuucagccugagugaauccaaccuagacgagauuaaaucuauacuccuggauaauaaccuuagcgccuccguccgccaaagaaaggcucugccuuugauuuaucagaccgccgcgucaaaggacagugaaaaacaguacaaggcaaucgccacugagcuccugaaagcuauuuuagggcugaaggccaaauuuaaucucaucacaggaaucgagguggaagacguuaaggcauggacccuuagcuucaacgcugaggauuucgacgccaaacugucugauuugaauauugcggacaacgaugacgccgugcaaauaaucgaaauucuaagggcacuguauuccgguguccuccugacgggcaucgugccagaggggcagucaauaagccaggcuaugauugauaaguacgaagcccauaaggcucaccuuaucaugcugcggaguauccgagagcaguugucugacaaagagaauaaggcccucgaaaaagcauaugaugacuacauugaucaccccgaggacaagcaacauggaucccgcgaagacuuuuaugccgcuaucacuaaaguacugaagaaggauagcgaggacaccaacauuauagaaaucuuaaaacugauugagcuagaucaguucaugccuaagcagagaacaaaagacaacggcgcgaucccacaccagcuccaucaacaggagcuggaucagaucauugaaaaucagaagcaauacuaccccuggcuugcagacauaaacccuaaugagcagaggcagaaaauggccccauauaaguuggaugaacugguuacuuuucgggugccguacuaugucggucccaugaucaccgcugaggaacaguuccaaacaucgaacaagaaauuugccuggaugauucgcaaggagccuggggcaaucaccccauggaauuucgaccagaaaguggauagacaggccucugcuaacgaguuuauuaagaggaugacgacuacagacaccuaccuccuggccgaagaugugcuucccaaacaaucccuguuguaucagcguuucgagguccucaaugaacugaacggaaucaagauagacgaucagccuaucacuguugagcagaagcaagcaauuuuuaaugacaaauucaugcagcaggcgcacgugacaguaaagaacauccaggcuuacuuagugucagagggccaauaugccagucggccaaauauuaccggccugagcgacggggaaaaauuuaacuccucucuaagcacguaccacgaucucaagaaaaucuucggagacaugauagaugaccccaauaagcagaccgauuuugagaaaaugauugaauggucaacaaucuucgaggacgguaagauuuucgcagauaagcugcgagaaaucaacuggcuuacugacgagcagagacagagguugaguaauaaacgcuaccggggcugggggcaacuguccaccaagcuccugacaaaaauagucgaucagaacggacagagaaucauugacaucuuauggaacacuaaugauaacuuuaugaggauuauccauagcgacgauuucgaccaagccgugacccaggcuaaucagaugcugcuugccgacaacgauacacaggacguuauaaaugaguuguauaccucuccgucaaacaagaaagcacuccgccaaauucugcuaguggucgcugauauccagaaggccaugaagggccaggcgccugcccgaauccugauugaauuugcucgggagaaacaggcaaauccccgucucaguacucaaagaaggcgccagguggaacagguauaccaggagcugaacaaugaccaacuuaacaaggaauuggccgauccacaguaugcuaaucugagcaaagaccgguuauuccucuacuuuaugcagggugggagagauauguauacgggcgagucccugaacaucgacaggcuuucugaguacgauauugaccacauacugccucaggccuucaucaaggauaauucguuggacaaccgaguucucgugagcgcaaaaaugaaucgcuccaagucagaccaugucccccuggauuuuacagaggaacgguucggacaaaagaugagaagucagugggaacagaugcuaagggcgggccugcucacccgucgcaaauauaacaaccugacucuuaauccagacucuuugaacaaguacaccaugagcggguuuauuaaucggcaacugguggagacaagacaggucaucaaauuagccaccaaccuccugguggaucaguacgcugacgaagauguucagcuugugacuguaaaguccggacugacacaccaaaugagggaggacuucgauuuucccaaaaaucgaaaccuaaauaacuaucaucacgccuucgacgcauaccucacggcuuuugucggucuguauuugcugaagaaguacccuaaauuagcccacuauuucguguacggccaguaucagcagggguucaaggcaaaugaucaauggcggaacuuuaauuuccucaacggacugcgccaggagcagcagguugacgccgaaaccggcgagcuuauuuggcaaaaagaucaugaccuggcuuacaugaauaagaucuacgauuuuaaaaagauauuggugacuagagaaguccacacaaaccauggugcgcucuauaaucagacccuguacaaagccaaggacgacaaggcaucagggcagggcggaaggcaacuaaucgcugccaaagagaaccggccaacagccauuuauggcggguacagcggaaagacuguggcuuauaugugccugguacgaaucaccgagaaaaagggugauuucuacagaauuuguggcgugcagacggcauggguugacgaacuugagcacaucgaagaugccaccauaaaacuccagcgccugacagcguugcugacuccgcaguuuucugcuaccaagaagcaaaaagacgaggucgugacaguggucaagcccuucgaaguuuuacucccuaaaauucugaucaaccagagguuuuaugaugggggacaggagcuuacucuggccuccgcaaccuacaagaauaacgcccaggaguuggugcucgacaaaaaggcugugcaaguacugaauggccagcuaccaaaggcagaacuggaggcccaggcgacggucguguacgaucagauccuugaacguguucaaaaauauuucccccucuacgacaugaacaguuuucgggagaagcuguucguggguagagauaaauuuaaugaauugccuuggcaggaccagugggagaaccacaaguuaauucaggucgggcaaaagacaauacuggauaggauccucauuggccugcaugcuaaugccgcaaugggagaccuuaaggcccugaacaugagcaccccauucggcaaguugcagaaaucuaaugggaucucccuaucacccgagacucagauuaucuaucaaaguccgacaggacuguucgaacgccgaguggcucucaaggaucuguga

SEQ ID NO: 3084 - RNA, 4095 nt, Artificial Sequence
  Cas9 variant
augaagaaccugaaagaguacuauaucggccucgacauugggaccgccagcgugggaugggcugucacagaugaauccuacaauauacccaaguucaacgguaaaaagauguggggcguuagacuuuuugacgaugcaaaaacugccgaggaaaggcggacgcagcgcgggucucgacguagacugaauaggcggaaggagcgcaucaacuuguuacaagaccuguucgcgaccgaaauuucaaagguggauccuaauuucuuccuaagacucgacaacagugaucuguauagggaggacaaagaugagaaacuuaaaagcaaguacacacuguuuaaugacaaagauuucaaggaccgggauuaucacaagaaauacccaacuauccaucacuugauuauggaccucaucgaagacgagggaaagaaagauauacgccugcuguaucucgcuugccauuacuuacugaagaaccgaggccacuuuaucuucgaaggucagaaauuugacaccaaaaauuccuucgauaagucuauuaacgaccuuaagauccauuugagagaugaguacaauauugaccuggaguuuaacaaugaagaucuaaucgagauaauuacagacaccacucucaacaagacaaauaaaaagaaagaacugaagaacaucguaggggauaccaaauuccuuaaggccauuucggcaaucaugaucggaucaagccagaagcugguggacuuguuugaggauggcgaauuugaggagacgacugucaaaaguguggacuucuccaccacagccuuugacgauaaguauucugaauacgaggaagcucucggcgacacuauuagccuguuaaacauacugaaauccaucuaugauucaaguauucucgagaaucuucugaaggacgcagauaaaagcaaggacgggaacaaguacaucucuaaagccuucguuaagaaauuuaauaagcacggaaaagauuugaagacccuaaagaggauaauuaaaaaguaucugccguccgaauacgcuaacaucuuccggaauaaaucaaucaacgacaauuauguggccuacacaaagagcaacauuaccaguaauaaacguacgaaggcgucuaaauuuacuaagcaggaggauuucuacaaguuuaucaaaaagcaccucgacacaauuaaagagaccaagcugaacuccagcgaaaaugaggaucuuaaacugauagacgaaauguugacugauaucgaguucaagacauuuauucccaagcucaaaucgucugacaacggugucaucccuuaucaacugaaguuaauggaacugaaaaagauccuagacaaucaguccaaauacuaugauuuccucaacgagucagacgaguacggcaccgugaaggauaagguagaaaguauuauggaguuucgcauaccauauuacguugggccccugaauccugacagcaaauaugcauggaucaagagagaaaacacgaaaauuaccccauggaacuucaaggauaucguggaccuugauuccucuagggaggaguuuauugaccgguugaucggacgauguacauaccugaaagaagagaagguccuccccaaggccagccugauauacaaugaguucauggugcuuaacgagcugaauaacuugaaacucaaugaguuccugaucacugaagagaugaagaaagcuauuuuugaagaguuauucaagaccaaaaagaaagugacacugaaggccgucucaaaccuacucaagaaagaauuuaaucugacuggcgauauccuuuugagugguaccgacggggauuucaagcagggacugaacuccuauauugacuuuaaaaauaucauaggcgauaagguugaccgcgacgauuacagaauuaaaaucgaggaaauuaucaagcucauagugcuguaugaggacgauaagacauaccuuaaaaagaaaaucaagagcgcauauaaaaacgacuucaccgaugacgagauuaagaagaucgcugcccugaauuacaaagauuggggcaggcuuucuaagcgguuuuugacugggauugaaggaguagacaaaacgacaggugagaagggcucaaucauauauuucaugcgcgaauacaaccucaaucugauggagcuaaugagugggcauuacaccuuuacugaagagguggagaaacugaacccugucgaaaauagagagcucugcuaugaaaugguggaugagcuguaccuuagcccauccguuaagaggauguuguggcagucucugcguguggucgacgagauuaagcggaucaucggaaaagauccgaagaaaauuuucaucgaaauggcgcgagccaaggaggcaaagaacucgagaaaggaaagcaggaagaacaaauuacucgaguuuuauaaguucggcaaaaaggcuuuuauuaaugaaauaggugaggagcgcuacaacuaucugcuuaaugaaaucaacuccgaggaagagucaaaauuccggugggacaaucuguacuuguauuacacccaacucgggagauguauguacagucuggaacccauugaccuagccgaucugaagucuaacaauaucuaugaccaggaucacauuuacccuaaaagcaagaucuaugacgauucccucgagaacagggugcugguaaagaaaaaucuuaaccaugagaagggcaaucaguacccaauacccgaaaaaguuuugaacaagaaugcuuauggauucuggaaaauccuguuugacaagggcuuaauugggcagaagaaauacacacgccucacccgacggacuccuuucgaggaacgugagcuggccgaauuuaucgagagacaaauuguggagacaaggcaggcaacgaaggaaaccgccaaccuucugaaaaauaucugccaggauucagagauagucuauagcaaggcugaaaacgcgucucgcuuccggcaagaguuugacauuaucaaauguagaacugugaacgaucuacaccacaugcaugacgcauaccucaauaucgucgugggaaacguuuacaauacaaaguucaccaagaacccacugaauuuuauuaaagauaaggacaacgugagguccuauaauuuggagaacauguucaaauacgauguaguccgagguaguuauacagccuggauagcugacgacagcgaaggcaaugugaaggccgcaacuaucaaaaagguuaagcgcgagcuggaagggaaaaacuaccgguuuaccagaaugucuuauauuggaacgggcgguuuauacgaucagaaucucaugaggaaggggaaaggccagaucccccagaaggagaacaccaauaaauccaacauugaaaaguauggaggcuacaauaaagccucaagugcuuacuucgcccugaucgagagcgacgggaaggcaggacgugagcgcacacuugaaacuauaccgaucaugguguauaaccaagagaaguacgguaauaccgaagcggucgauaaauaucugaaggacaacuuggagcuccaggauccuaaaauucugaaggacaaaaucaagauuaacucgcuaaucaagcuggauggcuuucuuuacaauauaaaagggaagacaggagacucccucucuauugcuggcagcgugcagcugaucguaaacaaagaagaacagaaguugaucaaaaagauggauaaguuccuggugaaaaagaaagacaauaaggauauuaaaguuacuucauucgacaacaucaaggaggaagaguuaauaaagcucuauaaaacccugagugauaaacuuaauaacgguauuuacuccaauaagcggaacaaucaagccaagaacaucucugaagcacuggacaaauuuaaggagauuagcaucgaagagaaaauagacgucuugaaucagauuauccuccuguuccaguccuauaacaaugggugcaaccuaaagucaaucggccugagcgccaagacgggagugguguuuauucccaaaaaguuaaauuacaaagaguguaagcucaucaaccagaguauuacaggccuguucgaaaacgaggucgauuuguuaaaucuguga

SEQ ID NO: 3085 - RNA, 4098 nt, Artificial Sequence
  Cas9 variant
auguacaagaaagacuauaccgugggccuggauaucgggagcacauccgucggauucgccgcuauugacgaugacuaccagcccauaagacucaaggguaaaaggguuaucggcgugcggcuuuuugaggaagggaagacugcagccgagcgccgaaacuuccguacgaccagaaggcggcugaaucgcagaaaauggagguugucuuuacuggaagagauuuuugauccuuauauggcgaagguagacccaacauucuuugcucggcuaaagcaaucaaaccucuucccgaaagauaagaauaaaaaguuuacuggaagucugcuuuuccccaaaaccacagacagcaaguuuuacgaugaauauccuaccaucuaccaucugcgcuaucacuugaugaacgacucccgaaaguucgaucucagagagauuuuucuggccauccaccauauagugaaauacaggggcaauuuccugaacucugcaccaaucgccucguuuucaacugacaagauuaaucucgucgaugacuucgagacagugaacgcugcauacuuacagaucaauagcaguaaccccguucagcuggacaccgaucaggccgaccaagugucccggauucuuuuggauaauaaacugucuaaccuagacaagcagaaacaggcugccaaggcgcucgcacagaaaagcggugauaagaagcaagacaaaaucaauaacacgacuauaaagcagauuugcaaagcccugcuuggguauaaguucgaucuggcugucguguugaauaucgacuccgaugaccacaacaaauggaagcuccagcugucagaugaaaacauugacagucguuuagccgagcugaccggagaacucaaugaggcacagcuugacauccugaacguauugagccgccuauacucucaaaucacacugaaugauauuguuccuuccggcaugacucucucagaggcuaugauagaaaaguauaaagcccauaagaaacaccugaagaugcuuaaagacuuugcgagaagccugaguaagaaggauuacggccaggugauggaggccuaugcagaauacaucgggaacauuccagagucugcuuccagcaaagcccagaagaaaaucucgcaagacgauuucuauaagaaaauaaagagguacuuggacgauucuaagcucggacagaaaauugcugaacugaucgccaagaaugaguuuaugcccaaacagcggaccaaccagaauggugucaucccuuaccaauuacaccugaaggagcuaaaccagauuaucgaaaaucaguccaaauauuacccauggcucgcagagcugaacccgaaugaaaagcgacgcggcaaagccaaguauaaacuuucagaguugguggcuuucaggauucccuacuauguggggccucugauaacacaggaggagcaacagaaaaccaguaacgcgaauuuugcauggaugaucagaaagagcgagggacggauuacgccauggaacuucgacgaaaaagucgaucgcaucgccacugcuaauagauuuaucaagaggaugacaaccaaagacacuuaccucauuggcgaggauguucugcccgcccauucccuucuguaugaacguuucaagguguugaacgagcucaacaugauacggguaaauaaccaccgacugucugugggucagaagcaggacgucuuugaaaaauuauuccaaaagcauaaaacagugaagaccagagagcugaucaaacagcuaauggcaagcgggcucccuacgcagccaaggauuaccggacugucagaucccgccaaguuuaauacaagucuuggcacuuacaacaauuucgcuaagaucuugggcgacgagauuaaccagccggaccgccaagaagauuuugagaaaaucauagaauggaucaccauuuucgacgauaaggacauccugaaaacaaagcucuccgagcugagcugguuagaugagaaacagauuaaugcccugaucaacaagaauuacucuggguggggacggcuuucaagaaaguugcucacugaacugaccaacaaaaagggucagaguauaauugacaggauguggaauacacaaaagagcuucaucgagauuaucaacgaaccuguuuuugcagagcagauaaaggaugcgaaucaggaccagcuagaugaagacgauuaugagaccgugcugcacgacgcuuacacuucuccccaaaacaaaaaggccauccgccaggucauuaaagugguagaugacaucguucgagcagccggccgggcuccaaaguucauuucccucgaguuugcccgugaagaccaggagucgagaaggacgcagagccgccugucccggaucaagaaaauauaugaaacaaccacuaaggagcuuguggcaaaugaucaaauuagagaagaguuggggaacgucaaagaccugaacgauagguuauuccucuacuuuacccagcugggacgagacgcuuauacaggcgagcgcaucaauaucgaugacauuucaaccaaguacgauaucgaccacauuuucccucgggccuuuauaaaagaugacagucuugauaacaaggugcuggucaagagagcggugaauaacgguaaaucuaauaacguucccuugaaacucuucggggccaaaaugaagccaaucuggaaaauguggaaggaccaucagcugauuagcaagaggaaauaugaacaccuaaugacuaaucccgacgcuaucgauaaguacaaagcaaacggcuuuauuaaucgucagcugaucgagacacgccaaauaaucaagcucgccgcuaacauucuggccaaucgguacuccacggaagacaccaaaaucauugaggugaaggcaaaccuuaaucaucaguugagacagucacugcacuuauauaagaacaggcaaguaaaugauuaccaucacgcggucgacggauaucucagcgccuucgugggccaguaccuguaucaccgauacccuucucuucaguccuauuuuguuuacgggcaguaccaacgguucuuugauaaacaggugcaggaaaacaugaaguucaaccgcuucaauuuucuguaugaccuaacugauagagacaacgaucagaucgucgugaaaaguacaggagagauaguaggugaaaagagcaaacucauugaacaaaucaaguggguguacagguauaaguucaugcugguuucucaggaggucuuuaccaaaacaggcccauuguucgaccagacuaucuacccggcuggguccaauaagucacggcugauucccauaaagaaggaucgaccuaccgacaucuauggaggcuacaguagcucgacggaugccuauauguccuuaauuagagugccagacaaaaaggaagacaaauacaagguggucgguguucccucucgcagccucgcaucacugaacagggcugagaagcgugggcaugaugccuaccuugaccagcugcggcaagugaucgcaaaaagucagaagaaagaguuucagauuaucauaccuaaguugagauauaggcagcucaucauugauggcggacugaaauacacccuaggcuccucugccuaucaauacaaugcucgccagcuggugcuuagcgaaaaguccauggagguacucgucacagacuucucaaaggugacuaccgaucuggacaaacagaaccaaaaguugaucgcgguuuaugaugacauucuggauaaagugaaucgauguuuaccacucuacgacaagaaccaguuuagaaaagcccugaauggggcacgggauaaguucguccagcuucccauccugccgaaguuuaacggaaauaaaaaggaagaggcugguaaaguggaaauauugaacgagauucuccugggccuacacgacgaugccagcacagggaaucugaagccucuuggaaucaaaacuccauucggcaugcuccagacccaaagugguaucacgaugucuuccaacgccguuauugugaaucagagccccacagggcuguuugagcauaggaucuauuugaaggcuuuacugaacaagcucaauaaauga

SEQ ID NO: 3086 - RNA, 4098 nt, Artificial Sequence
  Cas9 variant
augaccaagcugaaccagcccuacggcaucgggcucgacauuggaagcaauuccauagguuucgccguggucgaugcuaacucucaccuucugagauugaaaggcgagacagcaaucggggccagguuauuucgggaaggacaaucagcggcugaccgccgaggcagucguacuacgagaaggcggcugagccgcaccagauggaggcuauccuuccuccgggacuuuuucgccccucauauuacaaagaucgauccagacuuuuuccugcgccagaaauauucugagauuucgccgaaggauaaagaucgauuuaaguacgaaaagagacuuuucaaugacaggacugaugcagaguuuuaugaagacuaccccucaauguaucaucugcgguugcaccucaugacccacacacauaaagccgauccucgugagaucuuccuggcuauacaccacauccuuaagagccgcggucauuuucucaccccaggggcagccaaagacuucaacacugauaagguugacuuagaggacauuuuucccgcucugacagaagccuacgcacagguguauccugaucuugaguugaccuucgaccuggcaaaagccgaugacuucaaggcuaagcuacucgaugaacaggccacgccaagugacacucaaaaagcacugguaaaacuucuguuguccucugauggagagaaggagaucgugaagaaaagaaagcagguccucaccgaauuugcuaaagccauuacaggccugaagacuaaguucaauuuagcgcugggcaccgagguggacgaagccgaugcaagcaacuggcaguuuuccauggggcagcucgacgauaaauggucaaauaucgagacaaguaugaccgaccaaggaacggaaauauucgagcagauucaggagcuuuacagggcucggcuguugaacgguaucguucccgccggcaugagccuaucucaggcuaagguggccgacuacgggcaacacaaagaagaucuggagcucuuuaagacuuaucugaaaaagcugaaugaccaugaacuggcaaagacaauucgaggauuguacgaucgcuauaucaacggcgacgaugccaaaccuuuccucagagaggacuuugucaaggcucugaccaaagaagugacugcgcacccaaaugagguauccgagcaguuacugaacaggaugggucaggcaaauuucaugcuaaagcaacggacaaaagccaacggggcuaucccgguucagcuccagcagcgcgaacuggaucaaauuauagccaaucagucaaaguacuaugacuggcuugcaaagcccaacccuguggagaaacacagagccagcaagccauaccaguuggaugaacugcucaccuuuaggauccccuauuacgucggaccucugauuacgccaaaacagcaagcugagaguggcgaaaacguguucgccuggauggugcguaagaaucccucuggcaacaucaccccguacaauuuugacgagaaagucgaucgggaggcauccgcgaacacauucauacagcgaaugaagacuaccgacacauaucuuauugaugaagacguucugccuaagcagagcuugcucuaccagaaauaugaggugcugaaugaauuaaacaauguaagaaucaacaaugaggcucugucgacugaccaaaagcagaggcuaauccaugagguguuugaacgccacucuuccgucaccauuaaacaggugguugauaaccucguggcccauggggacuucgcacagcggcccgagaucagaggacuggccgaugaaaagagguuccuuucaaguuugagcacauaccaccaacugaaagagauucuccauggugcuauagacgauuccaccaagcugcacgacaucgaaaauauuaucacuuggucuacggucuuugaggaugccgcaaucuucaaaacaaaguuagcugagauugacuggcuggauccagccaccauaaagaaacuuagcaacauccgcuaucgaggcugggggcaguuuucacggaaguugcucgacggacugaaacuaggcaauggucacacugugauucaggaacugaugcucaguaaccauaaucugaugcaaauccuugcggaugagaccuugaaggaaacaaugaccgagcugaaccaggacaaauuaaagacugaugacauugaagacguaaucaacgaugccuacacauccccuagcaauaagaaagcucuccgucagguucugagaguggucgaggacauaaagcacgcagccaacgggcaggaucccucuuggcuuuauaucgagacggcugacggcaccggaacugccggcaaaaggacacaaucacgccagaagcagauucagaccguguacgcaaaugcggcccaagaacugaucgauagugcugucagaggggaguuggaagacaaaauugccgauaaggcgagcuucacagaccggcucgugcuguacuuuaugcagggagguagggauaucuauacuggcgcuccacuaaacauagaccagcugucccauuacgauauugaccacauccucccccagucucugauuaaggacgauucgcuugacaaucgaguuuuggugaacgccaccaucaaucgcgagaaaaacaauguauucgcaagcacgcuguuugccuccaagauggcugcgaccuggcggaaauggcacgaagccggguuaauaucaggaagaaagcucaggaaccugaugcuucguccugaugagacagacaaauucgcacauggcuuugucgcucgccaacugguggagacucggcagaucauuaagcuaaccgaacagaucgccgccgcucaauauccaaauacaaagauuaucgcaguuaaagccggucucagucaccagcugagagaggaauuggauuucccgaagaacagggacgugaaucauuaccaccaugcguuugaugcuuuccuggccgcacgaauagggacuuauuuacucaaacgguaccccaagcuggccccauuuuucaccuauggcgaguucgcuaaagucgacgugaagaaauuucgcgaguucaacuuuauuggagcacuuacgcacgccaagaagaauaucaucgcgaaagauacaggcgaaauuguaugggacaaggagagagauauccaggaacuggacaggauuuacaacuucaaacggauguugauaacccacgaggugcauuuugaaacugcugaucucuucgaccagacaaucuacgccgcaaaggacucuaaagagcgagggggaagaaugagccugauuccuaagaagcuagguuaucugaccggcaucuacgggggauaucaaacugagcgcggcuccuacguuucaauuaucaggaccuuuaaaaagggugaaacaauauauaaagucgugaacauccuuacggccgaugugagccuccugucugagaaggaaaaagucuccaagaccuuggcugacauuuaccugaaggaguuaaucgccaaaaagcucaguaaaggcaagagcgggaaaaauauugcaucugaacccuucgagaucguucugccucgugugggaaaggauucccuuuuuaagaacaaaaaguauggccuguucuugauagagucagcuacugaacuccacaauuaccaggagcuguggcuaccacggaacgaccagcugcuuauuaaaagaauccaggccaggcaaaucgaagagaguaaggcggauuacgaacucacacgcauguaucgaaauauugccuggcaaguggaccauuacuuuagacuguauaaaauacggaaguucgcagagaaguugcaggcuagcguagaggauuucgccggguuacccgucuacaaaaacgaaaccucggacggaaagguggagguucuggcuuccgugcucaaaaggcugaauggcgcagccgauaagggucgcacaaacccgacuaccgucaaacuucagucugacuuugggcguacgcuguugacaaauggaaucgugcuagaagaugacagcucaauuguuuaucagaguccuaccggccuguucaagagauccgugaaacucguagaucuguga

SEQ ID NO: 3087 - RNA, 4098 nt, Artificial Sequence
  Cas9 variant
augaccaaggaguacuaucugggccucgacguggggacaaacagcgucggaugggccguuacugauucccaguacaaucuuugcaaauucaagaaaaaggacaugugggguaucagacuguuugaaucugcuaacacggcaaaagauaggcgguugcaacgcggcaaucgacguagauuagagaggaagaagcagcggauugaccugcuacaggaaauauucucaccagagaucuguaaaauugauccuaccuuuuucauccgccucaacgaaaguagacugcaccuugaggacaagagcaaugauuuuaaauauccacuguucauugagaaggacuacuccgauaucgaauauuacaaagaguuuccgacaauauuccauuugaggaagcaccucaucgaaucugaggagaagcaggacauucggcugaucuaucuggcccuccauaacauuaucaaaacucgcgggcacuuuuuaauagauggagaccugcaaucggcgaagcagcuucgacccauuuuggauaccuuccugcuaucacuccaggaggaacagaaucugagcgugagucuuuccgaaaaccaaaaagacgaguacgaagagauccugaagaauagaucuauugcuaaaagcgagaagguaaagaaguugaagaaccucuuugaaaucuccgacgagcuggaaaaagaggaaaagaaagcccagucagcagugaucgagaauuucugcaaguuuauugucggcaacaaaggugauguguguaaguucuuaaggguuaguaaggaggaacuggagauagacagcuucucuuuuuccgaagggaaauacgaggaugacaucgugaagaaucucgaagagaaagucccugagaagguguaucuuuucgaacagaugaaagccauguacgauuggaacauucugguagacaucuuggagacagaagaguauauaucauuugcuaagguuaagcaguacgagaaacauaagaccaaucuacggcugcuccgugauauuauccugaaauauugcacuaaggacgaauacaaccgcauguucaacgaugagaaagaagcaggaagcuauacagccuacgugggcaaacuuaagaaaaauaacaagaaauacuggaucgagaagaaaagaaauccagaagaguuuuauaagagucugggcaaauugcucgacaagauugagccccugaaggaagauuuagagguccugaccaugaugaucgaagaguguaaaaaccacacgcuacucccuauucaaaagaauaaagacaacggggugauaccacaccaggugcaugaagucgagcugaagaaaauccuugagaaugcuaagaaguacuauucuuucuugacugaaaccgacaaagauggauacuccguugugcagaagauugagagcaucuuuagguuccggauccccuauuacguagguccucugucgacacgacaccaagaaaaaggcucuaacguguggaugguccgcaagccagggagagaggacaggauuuauccguggaauauggaagagauaaucgauuuugagaaauccaacgaaaauuucauuacucggaugaccaacaagugcacauaccucaucggagaggacgugcugcccaagcauucacuucuguacaguaaauauaugguuuugaaugaacucaacaaugugaagguccgcggcaaaaagcugccuaccagcuuaaaacagaagguguuugaggaucuguucgagaacaaguccaaaguaacggguaagaaccuacucgaauaccugcagauucaggacaaagauauccaaauagacgaucuuucuggguuugacaaggauuucaaaacuagcuugaagucauaucuggacuucaaaaagcagaucuuuggagaggaaauugagaaggaaaguauccagaauaugauugaggauaucauaaaauggauuacaaucuacggcaacgacaaggagaugcucaaaagaguuauuagggccaauuauuccaaccagcugaccgaggaacaaaugaagaaaaucacuggcuuccaguacagcggguggggaaauuuuucuaagauguucuuaaaggguauaucaggcagugacgugagcacaggggaaaccuuugauaucauuacggcgaugugggagaccgacaacaaucugaugcagauccuuuccaaaaaguucacauuuauggauaacgucgaagacuucaauucuggaaaagugggcaagauugauaaaaucacuuaugacucgaccgucaaggagauguuuuugagcccagagaacaagcgugcaguguggcagacaauacaaguugccgaagagauuaaaaaggugauggguugugaacccaaaaagaucuucaucgagauggcucgagggggcgaaaaaguaaagaagcggacuaaauccagaaaggcccagcuccuggagcuauacgcagcuugcgaggaagauuguagggagcugauuaaagaaaucgaggaccgcgaugagcgggacuuuaauucaaugaaacucuuccuguacuauacccaguuuggaaaaugcauguacaguggcgaugacauugauauaaacgaacuuaucagaggaaauucuaagugggacagggaccacauuuauccucagagcaagaucaaagaugacuccauugauaacuugguccuggugaauaagacauacaacgccaaaaagucaaacgaguuacucagcgaagacauccaaaagaagaugcacucuuucuggcugucccuucugaauaaaaaguugauaaccaagaguaaauaugaucgccucacucgaaagggggacuucacggaugaggaacugagcgguuuuaucgcgcggcagcuaguugagacacgucagucuaccaaagccauugcagacaucuucaagcaaauuuacuccucagagguggucuaugugaaaaguagccugguaucggauuuuagaaagaagccacucaacuaccugaaauccaggcgcgugaaugacuaccaucacgcuaaggaugccuaucuuaacaucguugucggcaauguguacaacaaaaaguucacuucuaaucccauacaguggaugaaaaagaaccgggacaccaauuauagcuugaacaagguguuugaacaugacgucguuauuaauggggaggugaucugggaaaaauguacauaccacgaggauaccaacacuuaugacggaggcacacuggauagaaucaggaagauuguggaacgagacaauauauuauacacggaguaugcuuacugcgagaaaggugaacucuucaacgccaccauccagaauaagaacgggaacucaacuguaagucugaaaaagggccuugaugucaagaaauacggaggcuauuuuuccgcaaauacaucuuacuucagccugauugaguuugaagacaagaaaggggaucgcgcccggcauaucauuggagugccgaucuauauagcuaacaugcuagagcacuccccuucagcguuccucgaauacugcgagcagaaggguuaucaaaauguuagaauccugguggagaaaauuaagaaaaacagcuugcugaucauuaauggcuaccccuuaaggauccguggggaaaacgaggucgacaccaguuuuaagcgcgcaauacagcucaagcuggaucagaaaaauuaugaacuugugcggaacauugagaaguuccuggagaaauacguugaaaagaaaggaaauuacccaaucgacgagaacagagaucacaucacacaugaaaagaugaaucaguuguaugaggugcuccugucuaagaugaaaaaguucaacaaaaagggcauggccgacccuuccgauaggauugagaaaagcaagcccaaguuuaucaaacuagaagaccugauagacaagauuaauguaaucaacaaaaugcuuaaucuccugcgaugugauaacgacacuaaggcugauuugucgcugauugaguuacccaaaaaugccgguucauucgucgugaagaagaacaccaucgggaaaucuaagauaauucucgugaaccaaagugucacgggccuguacgaaaaucggcgcgagcuuuga

SEQ ID NO: 3088 - RNA, 4098 nt, Artificial Sequence
  Cas9 variant
auggacaccgccaagacaaacaaacagcccuacuauaucggccuggauauggggacuagcuccgugggaugggcugucacggacgcaucuuacaauguugugaagaaacacgguaaggcccucuggggcguaagacuuuucgaggaagcgcaaaccgcugccgauaggcggcugcaucgcacagcacgacguagaauacagaggcggaaacagcgcuuggccuuacugcaggagcuauuugcuaaggaaauuugcaagguggacccuggguucuuuaucagacuccacgagucaaggcuguggcaagaagauaaaaguauugaccagccaaacacucuuuucaaugaugaggacuuugaugacaaggcauaucauaaagccuacccgaccaucuaucaucugcgguacgcuuugaugacagagaacaagagcuucgauguccgccucguguaucuggccauucaccacaucauaaaacaccgaggacauuuucugcucgaaaauuacgacuuauccaaccaggagaccucuggcuucgaugaaucguacaucgcgcugacuaaugcaauuaaggagcuuuugcagaaggagauccccguuggucacguggaaaagauucaaaucauacugaaggacaaaucacuaagcaagagagagaaaacagaaaagauucuccaggucugggacgugaucaaagauaagcagcugaaggagguaguucagcuuauuugugggggaaccgccaaccugaguacguuguuuauggacgaaucccucaaagaggcucugaagguguucgagaucaaagauucuaagaucagcuuuuccacugccgucuaugaagagaaagaaucagacuuacaaagugugcuggagcagagguucgaucucguguacgcagcuaagaugcuuuaugacuggagccuguuggccgaacuaaugggcgaucggaagacccugucugaggcgaaaauugccauauacgagacacauaagaaagaccucgaaguccugaagcgucuuacucgccaggauaaaucccuguauagaaaguuguuuaggggcaccgacaaggauucauacagcgcauauguugggaguugcaugauccacggagagaaacucgugauugaaaagcgggguucuacagaggaguucuacaaauuccugaagaaagagaucuccaaguuaccugacugugaggacaagauauacguacugagcaaaauugaagcugagaauuuucuaccaaaggccgugucgaccaucaacggcaucauucccuaucaacuccaggaacaggagcuggauaucauucuuaaaaaggcugagcaguacuugccuuuccugauggaaaaagacgccuaugggacgauaucugagaagaucaaacaacuccugacuuuucgcauuccauucuacgucggaccccuuaaucgacacuccgauaagucaugggcagugcauacagacaaggaaggcagaauccugccuuggaacuuuaaugagaggaucaacgaagagaaaagugccgagaaguucauuacccggaugacuaauaaaugcacauauuugcucgguaaggauguucugccgaaaaacagcuuacuguacaccgaauauaugcuauuuaacgagcucaauaacgugaagauagggaaggcuggaacguaccugaccgaagaacagaaagaaaaacuuuggaaagaguuguuccugacaacuaagaaagucacccucuccaaguuuucuaaguuccugaucaaagagggcauugacaaggaagaggcgguggaaaucaaaggcuuagaugggggauuuaagagcucacuggcaccauggauugaccuuaaaaauaucuugggugaggauuucacacgcgacaaggccgaagagauaaucaaggcuauuacucucuuuaguauggauaaaaagauccugaaaaaguaccuaaugagaauuguauccgagcccguugccaaacagcugagcaagcucagguauaccggcugggggcguuucucuaaagaguuccugacagaaaucaccccucgggugacugacgauguccaggugcuugucgacacgucaacaggagaaauaaugaacauuaucaccgcauugaagaagaccagucugaauuuaauggagauucucagcuccacuuacggcuauucugccgcuaucucggaggccaacaaagaacugguggguaauacaguucuuagcuacgagaccgugaaggaacugacuguauccccagcagucaaacgacccauauggcaaacauugaagaucauuaaagagaucacgcacauuaugggggcggaaccugcuagaaucuuuauagagauggccagggacaagcagccagauaagggccgcaccgacucacggaaaaagcagcucauugagcuguauaaaaaguguaaagaagaugugagaaguuggucuaacagggagagcaaggacuggguugaagagaucgaauccaagucagauagccagcuacgcucuaauaaacuguuccucuacuauacucaaaugggaaagugcauguacacaggcaaacccaucgaccugggggcacuuuugaagggacagcuguacgaucgagaccauauuuauccgcagucccagaccaaagaugacaguuuagauaaccucgugaucgucgacaaucgggagaaccgugauaagagcaauacauacccucugucuaagaacauuagagagaggcaaauagguuuuuggaaacuucugcgcgacaagggcuucaucuccaaagaaaaguauuuucggcuaacuagaaauacccccuucucagacgccgagaaagcugaauuuauugccaggcagcucguggagacgcgacagaguaccaaggcaguagcugaaauccugaagcgcguguugccaaaaagcauuaucguuuacgucaaggccgggcugacaucgcgguucagacaauauggagaguuuauaaaagugagggauuuaaacgacuaccaccaugcgaaggaugccuaucucaacaucgugacuggcaauguccacuacaccaaauucacauccaacccuauucguuuuguuaaggacugucagaucuacucucugaaugagcacgcucuuuauaaauacacuguggaacgcaacggugugguagcaugggcccccaaugaggaagggaugaugccaagcgucacccgguggaugaacaagaauaacauucuggugacgagaaugucauauguuggccagggagaguuguucgaucagcucccccugaagaaaggcaaggggcaagugagucugaaaaaggagggagcuaucuccgacauaucuaaauacgguggcuauaauagcgccuccacagcauacuuuauguaugucgaaggggaggauaacaagggaaagccuguguacguuauugaaaccaugccacuacaucuugcggccaggcucacuacacuggaggaaaaacagaaguacugcgaggaguuguggaugucaaccggcgguaaacugaagaauccgaaaguguuaaucgaacagauccccauucagagccucuucaguguagacggguuccgagucacuauagcuggcaagaccggaaagcaauauggcugucggcuggccgaggaacuugugcugaacaauggguacgcaaugacauugaaagcugugcucaaguuugucaaccgcagaaaaaugaauaaggaggcccugaucacgucuuaugaucaccuagaagagucccagcugcuugcacucuacgacguuuuccuggauaaauuggagcauagcugcuuuucgaagagguucucaacccagcgggacguguuaaagaacggacgagaaucuuauauugcccugagucucgaggacaaaugucagauccuguccgaaauucuucaccuguuucaaugcaacgcuacuuugagcaaucuaucucugcucggcagcuccaagcagucagguagacuguacaugaguaaaaaccuuagcgauaaggacucuugguauaucauacaccaguccguaacaggguucuacgagcaacauaucccuuuagcgccauacaaaaagucauga

SEQ ID NO: 3089 - RNA, 4098 nt, Artificial Sequence
  Cas9 variant
auggugaagaaaaaguacgccaucggcauugacauagggaccaacagcgucggaugguccguugugacagaugacuauaaaguacccucuaagaaaaugaagguguucgguaauacugagaagagauacaucaaaaagaaccugcucggcacgcuucuguuugaugaagggaauaccgcugagaacaggcgguugaaacgcacagcacgacguagauauacuaggcggcgcaauagaauuuuauaccugcaggaaaucuucgccgaggaaauuaacaagaucgacgauucauuuuuccaaaggcuagacgauaguuuucucauagucgaggacaaacagggaagcaagcacccuaucuucggcacccugcaggaggaaaagaaauaucauaagcaguuuccaacaauuuaccaccuucggaaacaacuggcggauuccucucagaaggcugacauccgcuugauuuaucucgcccuggcacauaucauaaaauaccgaggucacuuccuguuugagggggaucucaagucggaaaauaaagacgugcagcauuuauucaacgauuuuguugagauguucgacaagaccguggagggaucauaccugagcgaaaaucuuccgaacgucgccgacguguugguagagaagguuaguaaauccagaaggcuggaaaauauucuacacuauuuucccaacgagaagaaaaauggccucuucggcaacuuccuggcucuugcacugggguugcagccuaauuuuaagacuaacuucgaacucgccgaggaugcuaaaauccaauuuucuaaggagacauacgaagaggaccuggaagaguuacugggaaagauuggugaugacuaugccgaucucuucaucgcgaccaaaagccuuuacgacggcauccuguuggcagggauucuauccacgacugauucaaccacaaaggccccacugaguagcucuauggugaaccgguaugaggaacacaaaaaggaccucgcucugcuuaaaaauuuuauacaucagaaccuguccgauucauacaaggaggucuucaaugacaaguugaaagauggauaugccggcuacaucgaagguaagacuacccaggagaacuuuuaccguuucauuaaaaaggcaaucgaaaagauagaggggagcgacuauuuuauugacaagaucgaucgcgaagacuuccucagaaagcagaggacauuugauaauggaaguaucccccaccaaauucaucugcaggagaugcacgcuaucauucggcgacaggccgaguucuacccuuucuuaguggaaaaccaagacaaaauagagaagauccugaccuuccgcauuccauauuacgugggcccccuagcgagaggcaaaucugaauuugccuggcucaauaggaaguccgaugagaaaauccggccuuggaacuuugacgagauggucgauaaggaaacgagcgcagagaauuucaucacucgcaugacaaacuaugaccaguaccugccagaucagaaaguucuuccgaagcacucguugcuguaugaaaaguuugcuguguacaaugagcucaccaaaguaaaguucauugccgaagggaugagagacuaccaguuucuggauucuggacagaaaaaggacauagugaaaacucuuuucaagacaaagaggaaagucaccgcuaaggauaucaaagccuaucuggagaacuccaaugguuacgcaggcguggaguugaaggggcucgaggaacaauuuaacgccucacugcccacguaucaugacuuacugaaaauucuacgugacaaggcuuucaucgaugcggaagagaaucaggaaauucucgaggacaucguucugacccuuacauuguuugaggaucgggaaaugauacgaaagagacuggagaaauacaaggacauccucacugaggaacagaggaaaaagcuggaacgccggcacuauaccggauggggcagauuaagugcaaaacugauuaacgguauccuugauaaggugacaaggaagacuauuuugggguaccucaucgacgauggcaccagcaaccgcaauuucaugcaacugauaaacgacgauacacuauccuuugucgacgagauucgacuggcccagggaucuggcgaggcugaagauuaucgggccgaggugcagaaucucgcagggagcccugccaucaaaaaggguauucugcagucacuuaaaaucguagacgaauugauagagguuaugggauacgauccagagcauaucguggucgaaauggcucgugagaaccaauucaccaaucagggcagaaggaacagucagcagcgcuacaagaaaauugaaaaugccaucaagaaccuggacuccaauuuaaacagcaaaauucucaaggaguaucccacuaauaaccaagcacugcagaaugaccggcuuuuucuguacuauuugcagaacgggaaggauauguacacggacgaggaacucgauaucgaccaacugucucaguaugauauagaccacauuaucccucaggcguucaucaaagaugacucacuagauaauaaggugcugacaaaaagugcuaagaacagaggaaaaagcgacgaugucccaucccucgagauugugcauaagaagaaaaacuucuggaagcagcugcuugacucucaauugaucucgcagaggaaauuugacaaucugaccaaggccgaacgaggcgguuuaacuaacgaggauaaagcacgcuucauucagcggcagcucguugaaaccagacaaauaacaaagcacguggccaggauccuggacacccguuuuaauacuaaacuugaugaggcugggaaccgcauucgggaccccaaaguaaauaucauuacacucaagagcaaccuagucucccaguucagaaaagauuaccagcucuauaaggugagggaaaucaauaacuaccaccaugcccacgacgcauaccugaaugcuguuguggccacggcguugcugaaaaaguauccgcaguuagccccugaguuugucuacggcgauuaucccaaguacaacucauauaaaagucgaaagucugcuaccgagaaagugcuguucuacagcaauauaaugaacuuuuuccggcgcguacugguguauuccaagacuggagaaguuagaaucaggccagucauugaggugaauaaagaaacaggcgagaucgugugggacaagaagucagauuuucggaccguccgaaaaguucuuagcuacccucaagugaacgugguaaagaaagucgaaaugcagacagggggauucucuaaggaguccauucugcagcauggugacagugauaaauugauccccagaaagacugagaaauuuuaccucgacaccaagaaguauggcggguucgauagcccaacgauagcauacucugugcugcuaauugccgacaucgaaaaaggaaaggcuaaaaagcugaaacgcguuaaggagcuuaucggcauuaccauaauggaaaggauggccuucgagaagaaucccaucgaguuucucgaacacaaagguuauaagaacauucuggagaaaaacaucauuaaguugccuaaauacucccuguucgaauuagagaaugggcgucggagacuccuggcaucagcgaaggaacuucaaaagggcaacgagaugauccugccaccgcacuuggugacacuccuguaucauaguagcaauauacacaaaaucacugagcccauucaucuaaacuacgucaauaagaacaaacacgaauuuaaggagcugcuuaggcauaucucggacuucuccacccgcuauauucucgcccaggaucgacugucuaaaaucgaagaguuguacgacaagaaugauggagacgauauaagcgacuuaacaucaaguuuugugaaccugcucacuuucaccgcuauuggcgccccugcagcuuuuaaguuccugggguccguuaucgauagaaaacgguacacgucuaucgccgaaauucuugaggcaacacugauccaccagagcgugaccggauuguaugagacuaggauagaccuauccaagcugggcggugauuga

SEQ ID NO: 3090 - RNA, 4101 nt, Artificial Sequence
  Cas9 variant
augaagaaacccuacagcaucggccuggacauugggaccaacuccgugggaugggccgucauaacagaugacuauaagguuccugcuaaaaagaugaaagugcucgguaauacuaacaagaagacgaucaaaaagaaucuuauuggcgcacuguuguucgaugccgggaacaccgcggcugacagaagguuaaaacggacagcccgccgacguuacacuagaaggcggaaucgcauccuguaucuacaggagauuuuugcagccgaaaugaacaagcucgaugagucuuucuuucacagacuggacgauucauuccuuguaccagaagacaaaggaggcaguaaguacccgaucuuugguacccuggaggaagagaaggaguaucauaaacaauuccccacaauauaccacuugagaaagagccucgcugauuccaaagaaaaggcagaccugcggcugaucuaucucgccuuagcucauauuaucaaauaccgcgggcacuuucuguacgaggauaccuucgacauuaagaauaacgauauccagaaaauauuuaaugaguucacuucuauuuauaacaauaucuuugaagagucgucacuuagcaacgaaaaugcccagguggaggaaauuuucacagacaagaucaguaaguccgcgaaaaaggaccgagucuugaaacuguuuccugaugagaagucuaccggacuauucagcgaguuccucaaacugaucgugggcaacaaggcagacuuuaagaaacauuucgaucuugaagagauggccccacugcaguuuuccaaggacacguacgaugaagacuuggagucacuccugggccaaauuggggaugacuaugcugauuuauucguuguggccaaaaagcuguacgacgcaauacuccuugcuggaauccugagugucaaagaucccgccacuaaggcgccuuugagcgccucuaugauugaaagauaugacaaucaccagaacgaccuauccgcacugaagcaguuuaucaggucaaaccucccagagaaauacgcugaaguguucagcgaugacaguaaggaugguuaugccggcuacauagacgggaaaaccacacaggagggauuuuacaaguauauuaaaaaucaaaucucuaaguucgagggcacuaaguacuuucuggagaaaaucgaacgggaagauuuccuucguaagcagcgcaccuuugacaacgguuccauuccccaccagauccaucugcaggagaugaaugcuauuuugcaaaaccaagggggauauuacccuuuccucaaagccaauaaggaaagaauagagcagauccugacauuuaggauuccauauuacguaggcccguuagcacggggcaacagcgauuucgccuggcugacccgaaauucggacgaugcuauccgccccuggaacuucgaggaaguuguggacaaagcgucuuccgcagaggauuuuaucaauaagaugacgaacuaugaccuauaccucccugaagagaaaguccugccaaagcacucacuuuuguacgagacuuucgccguguauaaugaacugacaaaggugaaauuuauugcugaggccaugaaggauuacgaguuccucgacagugggcagaaaaggaagauagucgaaaacaucuuuaaaaaucauaggaagguuaccgaaaaggacauuaucaacuaucugcacaauguggauggauacgacgguauugagaucaaaggcauagagaagcaguucaacgcaagccuuuccacuuaucacgaucuguugaaaaucauuaaggacaaagaauuuauggauaaccccaagaauggggagauccucgaaucuauuauccauacacugaccauauucgaggaccgggaaaugauuaagcaguuacuggcccaguacaacagcguauuugaugagaaagugaucaaggcucuaucacgcaaacacuauacgggauggggcaagcucagugccaaacugauuaaugguaucagagacaagcaaaccgggaacuccauacuugauuacuugauggacgauggcaagagcaauaggaacuucaugcagcugaucaaagacgauggacucucuuuuaaggagauuaucgacaaagcacaggucgugggcgaaacagacaaucugcgucagguugugcaaaacuuaccugggucaccagcgauuaagaaaggaauccugcagaguauaaaacuugucgaugaguuggugaaaguaauggguagcgaccccgaauccauuguuaucgagauggcucgggaaaaucagacuaccaacaagggcaagucuaaaucgcagcaacgacucaagacacugagcgaugccaucuccgagcuagggucaaauauucugaaagagcauccgacugacaacauccagcuccagaaugauagacuguuccuuuacuauuugcagaacggaaaggacauguacaccggcgaagcacuggauauuaaucaauuaaguaacuaugacauagaucacaucauuccucaggccuuuaucaaagacgauucucucgacaacagcgugcugacauccucaaaggacaauagggguaagagcgauaacguccccucucuugagauuguggagaaaaugaagggguucuggcagcaacuguuggacuccaaacucaucagugaacgcaaguucaauaaccugaccaaagucgagcggggcggacuagaugaaagagacaaggugggcuuuauaaagaggcagcugguugagacucgccagaucacgaaacauguggcucagauucucgaugcccgauucaaugcagaaguaaacgagaagaaucaaaaacugcggagcgucaagaucauuacacuuaaaucuaacuugguguccaauuuucguaaggaguucgggcuguacaagguuagagaaaucaacgacuaucaccacgcucaugaugccuacuuaaaugcggugauagccaaagcuauucucaaggaguauccaaaacuggaaccugaguuugucuacggagacuaccagaaguaugaucuuaaaagguacaucucacgcaccaaggaccccaaggaaaucgagaaagcaacugaaaaguauuucuuuuacaguaaccugcuaaauuucuuuaaagauaagguguauuacgccgacgguaccauuauacagcggggcaacguagaguauagcaaagauacaggggagaucgcuuggaauaagaaaagagacuucgccauugugaggaagguucucucguacccacaggucaacaucgugaagaaaaccgaggaacaaacuggaggcuuuuccaaggaaucuauucugcccaaagguaacagcgacaaguugaucccucgaaaaacaaagaauauacagcuggauacgaccaaguacgggggcuucgacucaccagugaucgcauauaguauuuuacucgucgcggauguugagaaaggaaaguccaaaaagcugaaaacugugaagucucuuaucggcauuacaaucauggaaaaggugaaauucgaggccaacccgguagcuuuucuggaggggaagggauaccagaaugucguggaagagaacauaauucgcuugcccaaauauagccucuucgaacuggagaauggccggagaaggaugcuagccuccucaaaggagcugcagaaagguaacgaaaugguucuuccuagcuaccuccuggcauugcuguaucacgcuaagaagauccaaaagaaggacgagccagaacauuuagaguacaucaaacagcaccacagugaauuuaaugaucuccugaacuucgugucugacuuuucccagaaguauguccuugccgagagcaaucuggagaaaauuaagaacuuguacaucgauaaugaacaaaccaaccucgaggaaauagcaaauucguucauuaaccugcuaacauuuacugccuucggggcucccgcgguguuuaaauucuuuggaaaggacaucgagcguaagcgcuacucaaccguuacggaaauucugaaagccacccuuauccaucagucuauaacaggccucuaugagacucggauugaucugaguaaguugggugaggaauga

SEQ ID NO: 3091 - RNA, 4101 nt, Artificial Sequence
  Cas9 variant
auggacaagaaauacaacaucggccuggauauugggaccagcuccauaggauucguggccacagacgaggauaaucacgucaucagagcuaaggguaaaaacguuauuggcgugaggcucuuugacgaagggcagucugcagccgagcggcgcggauuccgaacuacgcguagaaggcuuaaucggcgcaaguggagacugaacuuguuaagggaaaucuuugagccccauauuuauccuaucgaugcgucauucuuuaugcggcaaaaauacaguaaucugagcaagcaggacccaaaccagaagauagaguucaaagauauccuauuuuccgacaagucugaugcugaguucuaucgccaguacccgaccauuuaucaccuccgacaagcccugaugacagagaaaagacaguuugaccuuagggaaaucuaccuggcaauucaucacaucguaaaguaucggggccauuucuuggaugagacucccaccgacaaauuuucguucgaucagcucgaccugacacaggaauuugagcgucugaauguccucuucucagagcaaaacccugaagaaccauucgaaauaguggugaaucagaaccagagcauugaggacaucuuaaguaaucaguccaugaccgccucugaucgcagaaagcaagcucugguuguguuuuaccagcagagcgaaaacaaggagaaugagaaacaauacaaggcaauugccacugaaauccuuaacuugcugcuagguaauaaagcuaagcucaacgucauccuggcccaggagguggacaaagaagcggcaaaggauuggucccuuucacugaguagcgagacauucgacgaugacuuggaaaaagccucuuccgggcucaacgauucacagcuggagaugguaggaauuuuugagaggauauauagcaguuuaauccugaagucuauuaucggcgaccacaauucccucagcgcugccaugguugauaaguucaaaacccacgcacagcaucgggaccuucugaaggaugugauaaagaacucggacgcuacgaagggcgaacaauugcaguuugccuacgaccacuaucuacagcgacauucugcggaugggaaagccuacggaaaggacgauuucuauaaggaggucaaaaagaaucuggacgauuccgacgcagcucagcaaauucagcagcucaucgauacugaccaguuuaugcccaaacaacgcaccaaggccaacggugcuaucccucaccaggugcagcagaaagaacuggaucuuauuaucgagaaucaaugccaguacuauccauggcuggccgaagagaaccccaauucagagagacacaacguggcaaaguacaaguuggacgaacucgucaguuucaggguuccuuacuaugugggcccacugauuagcccggccgaugacgagacagauccccaggcuauacaaaauacuaaauuugcguggaugauccggaaggacgcacaggggcgcauuaccccuuggaacuucgacgauaaaguagacagagaaaaguccgccgauaaauuuaucaagaggaugacaaccacggacacuuacuuaaucggagaggaugugcugccagaccagucucuaauuuaucagcguuacaagguccucaaugagcugaacaaugugcggauaaacggccgacccaucgaaguucaaauuaaacagaauaucuauacagaucuuuucaagaaauuuaagagcgugucagucaaaaaguugagaaguuaccuggaggaaauguccuauuacccugguagcuucaaaauuucugggcucaccaacccaggaaaguucgacaacggccugacuucauaccuugauuauaagaauauccugggcgacaguguggaugcuaacgacaaaagggccgauauagagcagaugaucgaauggagcacaauuuuugaggacaauaagaucuucgcacagaaauuggaguccaugaccuggcucacggccgaacaacgcaaggcuauuucucggaaaagauacaccggguggggaaggcugucgaacaaguuacugacacagcuaaagaaucaggacaaccgcagcaucauggaucuccugugggagacugaagagaauuuuaugaaaauacaguccgcccccgacuucucaaagaugauugaagcacauaaccaacaguuuaucaaaaaugaggcgaacauucagcaaguaaucagugaucuuuauaccucuccgcagaauaagaaagcuauacgacagaucuugcugguuguggacgauauucagaaggccgucggucacgcaccugagcauaucgccauugaguucgcuaagggcgaggacaaaaacccccggcguacaaucagcagagaaaugaagauacaagauguguaccagcagauuuccgacgauauccucgucucaccagaggugagggcccagcugaaugagaaaaucgaaaaccgccacgggcgguuaagcgacagacuguuucuuuauuucaugcaaggaggcagggauauguacacugguaagccuauuaauaucaacaacauuucucauuaugacauagaccacaucuugccccaggcauuuauuaaagaugacucccucgauaaucgaguucuggugagugacaagcuaaaccgcgaaaagagcgauaccguaccacgggaccuguucgggagagaaaugaugucuacaugggagaaaauggcugauaggggccucaucaccaagcguaaacuggccaaucuuaagacuauucccggauccaucgacgcgcacaaagcccagggcuuuauaaaccgccaguuggucgaaacgcggcaagugaucaagcuggcuguugggauuaugaucgaucaguacccugagacacagauugugucagucaaagcaaauuuaacccaugagaugagagaaauguucgaccucgugaagaacagggauguaaaugacuaccaccaugccuuugaugcuuaucugacugccuucgugggaaacuaccuucugcagcgauauccaaaguuggagccguacuucguuuaugacaaauuuaagaaacucaaggaccaaaauaucaguaugcgggauuucaaccugcuauacgaccugaaaaagaaugaagaugucuaugaccagcgcaccggucacagcgcacacaagauaugggaucagcauggcucgauugacuacaucagacaccucuuugcguacaaaaagauccuggugucccaugaggugcaccaaaacgggggagcccuuuauaauaugacagucuacggcaaagcugaugacgccaagaggaaauugauucccauaaaggcagauaagccuaccgaacuguaugguggguacacuucucggaaauuagcuuauauggccaucguuaagacgaaaaagggcaaaaaggagcaguaccaggugacaggagugccaguaagcgcacucaccacucugcgacaguucaaggaggacucacccgaacaaaaacaggcccuugaggaaauugucagacgcaacuuugaugagaagacagaaguggagaucauuguuccuaaagugcuguucaaucagcuaaucgucgacgagaaguguagguuuauggugggcagugauaccuaucguuacaacgcucagcaacucguucuguccgcggacgacuuggaaauaaucaacgccucucauaaagauauucagacaaucgacagcuccgauuacucacagcagcuggaccaaguguaucagaauauuuuaacuaucguagauaagcacuucccaauguacgacauaaacaaguuucggaccaaacuccacgauauuuaugagcaguacaucgaacugcccaaugaggacgucugggaaaacaauaaacuuacgacccuggggaaacauacaaucauuaucagaauauugcaaggacuccacgcaaacgcuacugugguggaucugaagcagcuagguauuaaaaccccguucggcuuuaugcagcaggccagggggaucgucguuagcccugacgcccaacugauuuaucagaguccaacaggacuuuacgagcgccgagugagacucggcgaucuguga

SEQ ID NO: 3092 - RNA, 4101 nt, Artificial Sequence
  Cas9 variant
augggggacagaaaguacaaccuggggcucgauaucggaaccagcuccauugguuucgccgcuguggacgagaauaaccagcccauaagggucaaaggcaagacagcaaucgggguucggcuuuuugaagagggaaaaacugccgcggaucgccgaggcuuccguacgaccagaaggcggcugucucgcagaagguggcggauuaauuuguuaaacgguaucuuugacgcucaccuggccgaaguggauccuacauuccuagcacgccucaaggagucaaaucgaaguaaccuggacccgaaaaagagcuuucaagggucccuucuguucccagaaagaaaggauuaucaguuuuacaaagaguaucccacuauuuaccauuugaggaaggcccucauggaggaagaccggaaauucgauauccgugagauauaucuggcuguacaccauaucauuaaguaccgcggaaauuuucugaacggcaccccuaugagaucuuucaaaguggaaaauaucgagcucgacacauuauuugauaggcugaaccagcuuuaugaggaaauuaucccagacaaugaguuggcauucgaucuggaacaggucgccgacgugaaggagguucuaucgucaaccacuauauacaagauggacaaaaagaaacaacucgugaagaugaugcugcuucccacaagcaacaaagcucugcagagugaaaauaagaaaauugucacccaguuugugaacgccaucuugaauuacaaguucaagcucgauguacuguuacagguugagacggacgcggauuggucccugaaacucaacgacgagggcgcagaugacaagcuggaagaguucacuggggaucuggacgaaaaccgguuggagauuaucgaucuacugcaacgacuccacaauugguuuucucugaacgaaaucaccaaagacggaaauagccuuuccgccgcuaugguggagaaguauaaagaucaucgccaccaccuggaguugcucaagaaggucauugaagaccauccugacgccaaaaaggcaaaagcucugaaggagacauacacugccuauguggguaaaaccgaugacaagacacagaaccaggaugacuucuacaaggcgguggaaaagaauuuagaugacucaccagaugccaaggagauaaaaagacugauccagcuagaccaauuuaugcccaagcagaggaccggccagaacggggcaauuccucaccaacuccaucagcaggaacuggaucagaucauagagaaacaaaguaaguauuacccauuccuugcugagccgaaucccaacgucaagcggcgcaaagacgccccuuauaaguuggaugaacugauugcuuuuaaaaucccauacuacguuggaccccucgugacgccugaggaacaggcccagaauggcgagaacguauucgcauggaugaagagaaaaguggccgguccaaucacucccuggaauuuugacaagaaagucgauaggauggagagcgcuaaccguuucauucggcgaaugacaaccaaggacacuuaucuguuuggggaagacgugcuuccggcggagucuaugaucuacgaaaaguucguugugcugaaugaguugaacaaucucaaaauuaacggaagacaccuguccuuaaaggauaaacaggacauauauaacgaucuguuuaagcaacagaaaacagucucaaucaaggcacuacagaauuacuaugugaccaagaaaaaggccgcuacggccccuaccguaggcggccucgcagaccccaaaaaguuccugagcagucuuucuacauacauugauuuuaaaaacauguucggggaacagguuaaugacccacaauuccaggaggauuuggagcagaucguggaaugguccacuaucuuugaggacaggggaauuuucaaggccaagcugcaggcucucgguuggcugagcgaaaaacaaauacagcaguuagucgccaagcgcuauaaaggcugggggcggcugucgaagaaacuuuugaccggacucaagaacgcagagggcuacucuauccuggaugaaauguggagauccacagagaauuuuaugcaaauucagucaaggccugaguucgcggcucuaauccagcaggccaacgaaaagcaauuugaggguaaugaccccaacaaugugugggaaaacauugagaauauccugggggaugcauacaccaguccacagaacaaaaaggccauacgccaggucgugaaaguugugcaggacaucgaaaaggcuguaggcaaucccccugagaaaauugccaucgaguucacucgagaagcagcugccaacccacaacggacacagagccgucucagaacccuggagaaacuuuaugaauccgcggaggaggucguggaugccagguugacugcugaacuggcagaguuuaaagaaaauaagcacguuuuaucugacaaguacuaucucuacuucacgcagcugggacgcgacguguauacaggcgauaccauuagccuugaccggcugaacgauuacgacgucgaucauaucuugccgcagucauuuauaaaagacgauagucucgacaacagagugcugacuauuagggccguaaauaacgggaaguccgauaaugugcccgcuaaaauguucggaaagaaaauggguagcuuuuggcgauaucuacuggacaacggcaugaucucuaagcgcaaguacaauaaccucauuaccgauccugacaauaucucaaaauacgcccaaaagggguucauaaaccggcagcugguugagacaagucaggucaucaaacuuaccgcaaauauuuugaacggaaucuaugacaaggauacugaaauuaucgaggugccagcgaaaaugaauagccaaaugagaaagauguuugaccuggugaaggucagggagguuaacgauuaccaccaugccuucgacgcuuauuuaacaauauucauuggcaauuaccucuauaaaugcuaccccaagcugcguccuuauuuuguguacgguaaauucaagaaauuuuccgauaacgaagacaucgaggugggggauggccgcuucaauuuucuuaaccggaucgaaagacugaagaacguaacggacccagagaccggagaaauucuauggucuaaugucgcccccaacgagacuaucaagaggauuaaaaagguguacaauuauaaauucaugauaguuucgcgagagaucacaacccggcgcgcagaacucuuuaaccagacaguguacccgaagaauuauagaggcaaacugauuccuaucaaggaggauaggccaacugacuuguacgggggauauagcgguaacaccgaugcuuaccuggccauugucgcauuagaagacaagaaaaagggcaaauauuucaaggugguugggauccccacgcgggccgcugcgaaacucgagaagcugaaacagcaggauucccaacaguaccuucaggccgugcacgaaguaauagcaccucaguuuaccaagucaacaaagaaaggaaucaagaaaacugaguuccgaauuguccuggacaaggugcauuacagacaauuggugcaggacggccccgucaaaaugaugcucgguaguucuaccuauaaguacaaugcuaagcagcugguucuaagcgagaaagcccuucaggugaucaaggaugaccgcaaauuugaugaaacacaaaaggacgauaaccuuauugccguauaugacgagauccucuccauagugaaucagucauucgaucuguacgacauuaacggguucaggaaaaaguugaaugauaaccguaaucaguuuaucgaccugccagcugaaacuaaguaugagggccggaaagucguggcacacggaaagagagagaugaucuuagaaauucucaaaggccugcacgccaacgcgagcuucgggaaucuuaagccuauaggauuugcuacccccuucggccagaugcaaucuaaaaacgguaucgagcuguccgaaaaugccuuuuugauucaucagaguccaagcggccucuucgagcacaagaucaagcugucugaucuauga

SEQ ID NO: 3093 - RNA, 4101 nt, Artificial Sequence
  Cas9 variant
augaccaagcugggcaaacccuacgggaucggaguggacauugguagcaacuccauaggcuucgccgcugucgaugaaaauucucaccucaucagacuuaaggggaaaacaguuauuggagcaaggcuguuugaagagggcaaggccgcggcuuaucggcgcgccucacgaacuacgcguagaagguugagucggaaccgcuggagacugagcuuccugagggacuuuuucgaaucccauaucaccccuacagauccaaauuucuucaugcggcagaaauacucugagauuucgccgaaggacaaggcacgcuauaaauacgaaaagcgacuauuuaacgauagaacugacgccgaguucuaucaacaguaccccaccauguaucaccucaggacacggcugcuuaccgauccuucaaaagcugacgugcgugagaucuacuuugcaauacaucacaucuuaaagagccgcggucauuucuugacuccaggguacgccaaagauuuuaauacaaacaagguagcucucaaugaaauuuuccccgcccugcaggacgcguaugcacagguguacccugaucuggacaucaccuuugaugagaacaaggucaaugaauuuaaaacggugcucuuaaacgagaaggccacuccaagugacacccaaagagcucugguuaaucuuuugcuggccaaagagggagacagggauauucuaaagcagcagaaacaggugcucacagaguucgcaaaggcugucgugggccugaaaacuaaacuuaacguagcccugggcaccgagguugacuccucugaagcgacagccuggaauuuuagcuuggggcaacucgaugacaagugggcaggaaucgaguccgcuaugaccgaugaagguacggagauacuggaccagauucgggauuuauaucgagcccgccugcucaacggcaucgugcccgcugggaaaacucuuucacaggccaaggucgacgauuacgcacagcaccacgaggaccuggaauuguucaaagauuaucuaaagcaacuggaggacgacggaacagccaaagcuauuagacagcucuacgauagguauaucgacggcgaugacgcgaagccuuuugugcgggaagauuucgugaaggcacugaccaaagaggucacugcccauccaaaugcuaagaguccggaacuucuggagcgcuuggcccagcccgacuuuaugcucaaacaaagaaacaaggcaaacggugccaucccuguucagaugcagcagagggagcuggaucaaauuauaaagaaucaggcuguguacuacgacugguuagccgcaccaaaccccguagaaaagcaccgucagagcaugacauaucagcuggaugagcuacucaauuuccggaucccuuacuauguggggccacuggucaccgcgaaggaacaaaaagcugcccagggaggcguguuugcauggaugguucgaaaggaccccgauggcaacauuacgccguacaauuucgacgagaaaguggauagagaagccucugcuaacaccuuuauccagaggaugaagacaacugacaccuaucuuauaggggaggacgucuugccuaaacagucccugcucuaccaaucauaugaggugcugaaugaacuuaacaauguacgcguuaacgauaauaagcugagcuucgaccagaagcaacagguguugggagagcucuuugaacggcauaacacagucacuauuaaacaguucguggauaaucuguuagcccacggugacuacgauagaauccccgaggucaggggccuggcagacgagaagcgcuuucuaaguucucucuccaccuacaaccagcugaaagggauccuucacgaagcuauugaugacgccgauaagcagacagacaucgagaauauuauagcguggagcaccaucuucgaagauaaagccauuuucaagacuaaauugaacgagaucucguggcugaacgcuggaaugaucaauucucucgcaaacauucgauaucggggcuggggucaauuuucccauaagcuguuaaaugaacugacgcuuucaacagggcguaccguguucgaggaguugcucauaaguagcagaaaccugaugcagauccuaacugacgaaguucugaagcagaaaauugccgagcucaaugcucacgaacugaaggccuccggcaucuacgcagcgauugaugacgccuauaccucuccaagcaacaaaaaggcucuuaggcaaguguugucaguaaucgacgauauaacaaaugccgcaggacaggcuccuaacuggcuguacaucgagaccgccgacggcgaugggguccccggaaaacgcacuaauagucggcagagaaagauucaggaaaucuaugcaaacgccgcucaggaguuaauuacagguuccgugaggggcgaguuugaagacaagaucgcgagccgagccgauuucacggaccgccucguucuguacuuuaugcaagggggacgggauauauauaccggcgagccacuuaauauugacaaccugucuucauacgauaucgaccauauuuugccccagagucucaucaaagauaauagccuggacaacagagugcuaguccacccucuggugaauagggaaaaggacacuauauucgcauccacacguuuugcuaaacagaugaacgguauguggcgccaguggcaugccgccgggcucaucucuucgcggaagcugagaaaccuucaaaugaggccagaugagauugacaaauacgcuagcggcuucguagcacgacaguugguggaaacccggcagaucauuaagcugacagagcaaaucguugccgaucaguauccggacacuaagauaauugcggucaaagcuggauuauccucacagcuccgcaaggagcuggauuuucccaaaaauagagaagugaaccacuaccaccaugccuucgacgcauuucuugccgcuaggaucggcaccuaucugcuaaagcgguacccuaaucucgagccauucuuuacguaugggaaauucaagaagaccgaagugaaaaagcugaaaaguuugaagucucugaaauccuucaacuuuauccgagauaugacacacgcaaaggacaaaauugucgccaaggagacuggagagaucguuugggauaaugcgagcgacauuaacgaauuagauagaauauacaauuucaagcgcaugcucaucacccaugaggugagguuugaaacagcuucacuguucaaacagacucuuuaugccgcaaagaacagcaaaaaucgugguggcucucggcaacugauucccaagaaaaagggguacuugguggacaucuacggaggcuauacccaggagacggguuccuaccucaguguagucagacugacaaagaaagccauguaugcugugguuaaggugagcaccagggaugccgcaaaacuagcugucgccaagucuauuuccgaacagaaagagaacgagacucugaagaagaucauagacgggaaacuuucaaagacaaguaaaaagggcaaaaccacucaccagcucuuugaaaucgugcugccucgcguuggacaaaagaccuuguucaagaauagcaaauacaaccaguuucugguaaauucggacacauauaugcacaacuaccaggaguuauggaugccacgagaauaucagagaauguggaaggauauucuccuguccaaucauggcgacgcgcaaaucgaggggcagcuugaucagauuuucaaauuuaucgugucucaggucaacagcuacuucaaccuguacgacauaaaucaauuucggaagaaaauugccgaugcaacggacaaguucgcuaaguugcccacccacgauacugacaacgccaggggaaaaaucgcuacaaucggccagcuccugauuggucuacaggcaaaugccaugcgcucagaucugcguaaccuugacauaaagaccccguucgggcuccugcaaaucggaacaggcauuacuuuggauuuagacaccaguaucauuuaucaguccccuacgggucuguuugaaagagaggugccacucacagaucuguga

SEQ ID NO: 3094 - RNA, 4101 nt, Artificial Sequence
  Cas9 variant
augaccaaggacuacagccugggccucgauaucgggacaggauccguggguuucgccgcucuugacacuaacuauagacuguugagggcaaaaggcaauaacgucauugggguucgguuauuuacgcccgccgagaccgcggaggagcgccgaggauuccguacagcuagaaggcggcugucucgcagaagguggcggcuaggcgcccucaaugguauauuugcaccugaacuggccaagguggauccaaacuuccuucaccgccugaaauacgcuuggguacauccggcagaccagcaaaauaaggggaaauauucagccgcucccuuguuuaacgaugccgcgcucgaccgacaguuccacgaugacuacccuacuaucuaucaucugagacugaagcucaugaccgauacaagucagcacgacuuaagggagguguaccuggcaauucaucacaucauuaaguuucggggaaauuuccuucguggcgaaggcccaaucaacgccagcgaggcuuuugauauaaauaccuucaucgaccagaugacugccuuuuaugaucaagcauuccccgacuuuaaaauugucgaccagguggaucagcagaucauuuucaagggguugacagacaugacccuguccccugcugaucgcgccaacaaagcgcuaaugggauucaauaacgccgcacaacagccaaauaagagaaucuuuaaagcuauacucucuggucugguuggcaaccagguggaccuuauggccauuuuccagcuggaugggauccccaaggaggaccaaaaggaauuuaaauucaaguuugucgauaaugacauugaggaaaaauuggcugcccucggagauaacccugcacugucggacgagcagaacgaguucuuaacgacucuguacgccgcuuuuucaggccucacccuuaagggucuguugggggaugcgacaagcaucagugcagccaugguggcuagguacgccucccaccggacugacuggaccuauaucaaagaccauguacuaacaccacagaauaaccgagaacugcgccucgcauacgccgaucugaugaccgacaaugaggauguuagacuuaaggcuggaaagaaguucgccaaggcaauugaagcggcugacauaccggccgcaaagaagucugaguuuagccugaaaaucgauaacaaugaguucuugcccaggcaacggacgaaggccaacggcacuauuccucaccagcuccaucugaaugaauuacagcagaucauagagaaccaaggccaguauuacccauuucugaaagcuacauucgaacaggacgggcacacccuaaauaagauugagggacucgugaaguuucgcguccccuauuacguggguccucuggugccaaaacacaaggucgccggcaacaaugcaaaccauuggaugguucccaaagaaccgggggcuaucacuccuuggaauuauacagagaagguggauagagacaaauccggaaacgaguucaucaggcguaugaccggcacggauaccuaccuuuugggugaacccacacugccaaagaacucacucguauaccaggaguucaaugugcugcaagaacuuaacaaucugcggauugagaagcgaagauuggacaucgccgucaaacaggauauuuuugaacacguguucaagacuaacaaaaccguuacagugaagaggauagaggaauaucucacuaccgaguuugggaguccugucacacugagcggcuucgcgaaugugaacgagcgcaaauuaaauucuucccugucaaccuaccauuauuuuguaggaaucuucggcgccgaauuuguugacgaucccaagaaccuaacucuccuggagcagauuguggaacuucagacggucuucgaggaccggaaggcuuugcaaagacagcugaaacucaggccagagcugagcgaaaaacaggugaaacaguuagcacgcacacacuacaccggguggggacgacugagucaaaaacuuuugacuucuaaaaucguccauguggcccucgagggugaacgggagcccggccaguauuccauccuggaaacccuauacgggacacagaugaauuuuauggagauuguuaacgacaugaaggaucguuauggagugaaaagcuggcuggaccaagaaaauucgggcucugaaaacaaucucucccugaagcagagaauacuugauaugccugguccaaagaacaucaaaagggggauuaaucaggcuuuccacaucauugacgagaucacccgcgccguaggcaacgcaccgucacggauauacaucgaauuugcgagagagagucagcaaagcaauuugacuaacgccagggucaaccgacugaagcaguuauacuccaaucaggcucucaaaaaggaguucgccaaacuggcaucugaaauuaaggaucuuacaaaggagcagcugaaagacgaucgcuuguaucucuacuaucugcaacagggaaaggacauguacacggaaaccgauaucgacauuacuaaaaucagcucaaacuaucagauagaucacauuaucccccaggcuuacacaaagaauaacagucuagacaaucgggugcugguuaacuccgagaugaaugccagaaaaagcgauucuccuaccuuucucccaucacugauucaagaaaggaaggcaugguggcgucagcuucgcgacacaggcuugaugaguacuaucaaguauaacaaucugacccggacgagcgacgauuucuccgccgaccagaaagagagauucauagcuaggucuuuaguggaaacccgacaagucaucaagaacguggcgacacucauuaaagaguacuacgaugacucgcagguagaggcccugcccagcgaaaucacugcagagaugcggcgcuaucuuaaugugagaaagaacagggauauuaaugacuaccaucacgcucaugaugcccugcuauuugccaccgcuggggaguucucccggaaaguuggaaucauggaaaagggucgagucucagacggcgcagggaacauauauaauagauacacaaaggauauuauccagcgcgccagggcgaaagcuggacaggacaagaaagugcguccuuuuacuuucaucgugggcaguauggccaacccagauaccaaguuucaaacgaaccagacaaccggugagauugucuggacucccgaagacguugcauaucuccggaaagugaucgacuacaagaaaaugcuggugacaaagaugaccuuggaucagacugggacccuguauaaugagacaagauacggcucuggagacaagcacguagccgucgcuuuaagcaaagauaaggcagccgaccucuacggcggguucggaucccugaaaccggcguaugcugcccuuguguacucaaagaaaaaguuuaggcugguuaacguguugcgccucuggcugccugaaauuaagaaaaaugcaagcguccuagagcgaaaggugcagucuguucugggcgaugacaacgccaaagugauaagagcucacguaccaugcggucaacuucucaucaaggauggggcccuggucacgguguccagugcaaccgaauugcauaauuuccggcagcugugguuacccaaagcugacuaucaggauauuagcauccuccugggagccccugacaaggugacugcggagaacaggcuucaggccgagucucacuuugaugacgucgaucaacgcuucgaaucccuguugaaggacguuauugaccaggcacgucaguacuauccccucaaaacacaucagaccucacuggagaagcuaaucggcaaaauagguaaguuugaugaacugaaauucgcucaaaagcaacagguguucaguagacuucucagcgcccugcacgcuaaugcaacaaacucggacuugaagcagaucggcuuauccacugccugggggcggcugauuuacccaaaaggaguaucucucaccgaugaggacaagcugaucaauagcucauuuacgggccuuuucaacgaugugaugaguauuaaagaauuucaugacuucuccaucaauuga

SEQ ID NO: 3095 - RNA, 4104 nt, Artificial Sequence
  Cas9 variant
augaagaaacagaaguucagcgacuacuaucugggcuuugauaucgggaccaacuccgugggauggugcauuacagaccucgauuacaauguccuuagauucaacaaaaaggacaugugggguucuaggcuguuugaggaagccaaaacugcugcagagcggcgcguucaacgaaauucacguagaagguugaagcggcgcaaguggagauuaaaccugcuagaagagauauucaguaaugaaauccucaaaauugauagcaacuuuuucaggcggcugaaggaguccucucuuuggcuggaggacaaaucgucaaaggaaaaauuuacguuguucaaugaugacaacuauaaggauuacgacuuuuauaagcaguaccccaccaucuuccaccuccgcaaugagcugauuaaaaacccugaaaagaaagauauccgacugguguaucucgccauacauagcaucuuuaagaguagaggccacuucuuauuugaggggcagaaucugaaagagauuaagaacuucgaaacacuuuacaauaacuugaucgcguuccuggaggacaauggaauuaacaaaaucauagauaagaacaauauugaaaagcuagagaaaaucguaugugacuccaagaaaggccucaaggacaaagaaaaggaguuuaaggagauuuucaacucugauaaacagcugguggcuaucuuuaaacuuagcgucgguuccucagugagucugaaugacuuguucgauacugacgaauacaaaaagggggagguugaaaaagagaagaucagcuuuagggaacaaauuuaugaggaugacaagccaauauacuauucuauccucggagagaaaauugaacuguuagauaucgccaaguccuucuacgacuuuauggugcugaacaauauacucgcagauucacaguauauuagcgaggccaaagucaaacuuuacgaggagcauaaaaaggaccugaagaacuugaaauauaucauccggaaguacaauaaaggcaacuacgauaagcuauucaaagacaagaaugaaaacaauuauagugcuuacauuggccugaacaaagagaaggggaagaaagaggugguagaaaagucucgucucaaaaucgacgaucugauuaagguuauaaaaggauaucuuccgaagcccgagcgcaucgaagagaaggacaaaaccguguuuaaugagauucuguccaagaucgaauugaaaacaauccucccuaagcagagaauuagcgauaacgguacccugccauaccagauacacgaggucgaauuagagaaaauccuggaaaaucaaucgaaguauuacgacuuccuaaacuaugaggagaacggcgugucuacuaaggauaaacuccugaagacauuuaaauucaggauucccuacuacguggggccucuuaauuccuaucauaaggacaaaggaggcaacucauggaucguccggaaggaagaggguaagauuuugccauggaauuuugaacagaaaguugauaucgagaagagugcagaagaguucauaaaacgaaugaccaacaagugcacguaccugaauggggaggacgugauccccaaagauacuuuccucuauagcgaauacguaauucugaacgagcuuaauaaggugcaggucaacgacgaauuucugaaugaggaaaacaaacgcaagaucauugaugaguuguucaaggagaauaaaaagguguccgaaaagaaguuuaaagaguaucuccugguuaagcagaucguggacggaaccauagaauuaaagggcgucaaagauucuuucaacagcaauuacauuucauauaucagauuuaaggacauuuucggcgagaaacugaaccuagacaucuacaaggagauaagugaaaaauccauccucuggaagugucuguacggggaugacaagaaaauuuuugagaagaaaaucaagaaugaauauggagauauucuuacaaaagacgagaucaagaagauaaacacuuucaaauuuaacaauugggguagguugagcgaaaagcugcucaccggcauugaguucaucaaccuggagacaggggaaugcuacucuucagugauggaugccuuacggcgcaccaauuauaaccugauggagcuuuugaguagcaaauuuacgcuccaagaauccaucaauaacgagaauaaggaaaugaacgaggcuucuuacagagaccugauugaggaaucguauguaagcccuucccuaaaaagggccaucuuccagacucugaagauuuacgaggaaauacguaagaucacaggacggguuccaaagaagguguuuauugagauggcgcgaggcggugaugaaucaaugaaaaauaagaaaaucccggcaagacaggagcaacucaagaaacuguaugacaguugugggaacgauauugccaauuucucuaucgacauaaaggagaugaagaacagccuuaucuccuacgauaauaacucauugaggcagaaaaagcuguacuuauauuaccuccaguucggcaaaugcauguauaccggacgcgaaauugaccuggaucggcuucugcagaauaacgacacuuacgacaucgaucacauuuaucccagaagcaaggucaucaaagacgauucuuuugacaacuuggugcucguccugaagaaugagaacgcugaaaaguccaaugaguacccugugaaaaaggagauacaagaaaagaugaagaguuucuggagguuucuaaaagagaagaacuucauuagcgaugaaaaguauaaacgccugacaggcaaggacgauuuugagcuccgaggguucauggcccggcagcugguuaaugugcgucagaccacgaaagaaguaggaaagauccuucagcaaaucgagccagagauuaaaauagucuacucuaaggcagaaaucgcuuccucauuuagagagauguucgacuuuauuaaggugagggaauugaacgauacccaccaugccaaagacgcguaccugaauaucguugccgguaacguguauaauacaaaguucacugagaaacccuaccgcuauuuacaggaaauuaaggagaacuacgaugucaaaaagaucuauaauuacgacaucaaaaacgcaugggacaaggagaauagucucgaaauagugaagaaaaacauggagaagaauaccguaaacauuacacgguuuaucaaagaagagaagggccagcuguucgaucuuaauccuauuaaaaagggggaaacuagcaacgagaucauaucgauuaagccaaaaguguauaacggaaaggacgauaaacugaaugagaaguacggcuacuauaaaucccuaaaccccgcuuacuuccucuauguugaacacaaggagaagaauaaaagaaucaagucuuuugaaagggucaaccugguggacgugaauaacaucaaagaugaaaagagcuuggucaaauaccugauugagaauaagaaguuaguugaaccgcgagugaucaaaaagguguauaaacgccagguaauacucauuaaccauuacccuuauucaaucgucacccuggacaguaauaaacuuauggauuucgagaaccugaaacccuuguuucucgaaaauaaguacgagaaaauucugaagaacgugaucaaguuccuagaagacaaucaagguaaauccgaggagaacuacaaguuuauauaucugaaaaagaaagaucgguacgaaaagaaugagacacuugaaucuguuaaggacagauauaaccucgaguucaacgaaauguacgauaaauuucuggagaaguuggacagcaaagauuauaagaauuacaugaacaauaaaaaguaucaggagcuguuagacgugaaggaaaaauucauuaagcucaaccuguuugacaaagccuucacccuuaaguccuuucuggauuuguucaauaggaaaacuauggcugacuuuucaaaggucgggcucacgaaguaccugggcaaaauccagaagaucagcaguaacgugcuaucuaaaaaugagcuguaccuucucgaagaguccguuacaggacuguucgugaagaaaauuaaguuguga

SEQ ID NO: 3096 - RNA, 4104 nt, Artificial Sequence
  Cas9 variant
augaagaaacagaaguucagcgacuacuaucugggcuuugauaucgggaccaacuccgugggauggugcgucacagaccucgauuacaauguucuuagauucaacaaaaaggacaugugggguucuaggcuguuugaugaggccaaaacugcugcagaacggcgcgugcaacgaaauucacguagaagguugaagcggcgcaaguggagauuaaaccugcuagaggaaauuuucagugacgagauaaugaaaaucgauagcaacuuuuucaggcggcucaaggaauccucucuguggcuugaggacaaaaauucgaaggagaaauuuacgcuguucaaugaugacaacuauaaggauuacgacuuuuauaagcaguaccccaccauuuuccacuugcgcgaugaacucaucaaaaauccugagaagaaagacauucgacugaucuaucuggcccuccauucaauauuuaagagcagaggccacuucuuauuugaagggcagaaccugaaagagaucaagaauuucgagacacuuuacaacaauuugauuaguuuccuggaagacaacggaaucaauaaauccauugauaaggacaacaucaagaaacuagagaagauaauuugugauucuggcaaaggucucaaggacaaagaaaaggaguuuaaggaaaucuucaacagcgauaaacagcugguagcgauuuuuaaacuuuccguggggucaagugucagccugaaugacuuguucgauacugacgaguacaaaaaggaggaaguggagaaagaaaagaucucuuuuagggagcaaaucuaugaagaugacaagccaauuuacuauuccauacucggagagaaaaucgagcuguuagauauugcuaagucauucuacgacuuuaugguucugaacaauauccucagcgacaguaacuauauaucugaagccaaagugaaacuuuacgaggaacauaaaaaggaucugaagaauuugaaauauauuauccggaaguacaacaaagagaauuacgacaagcuauucaaagauaagaacgaaaauaacuauccggcauacaucggccugaauaaagagaagggcaagaaagaggucguggaaaaguccgggcucaaaauugacgaucugaucaagguaauuaaaggauaucuucccaagccugagcguauagaagagaaggacaaaaccaucuuuaacgagauucugaauaagaucgaauugaaaacaauccucccaaagcagcgcauuagcgauaacgguacccugcccuaccagauacacgagguugaauuagagaaaauccuggaaaaucagucgaaguauuacgacuuccuaaacuaugaggagaacggcgugucuacuaaggauaaacuccugaagacauuuaaauucaggauuccuuacuacgucgggccacuuaauuccuaucauaaggacaaaggaggcaacucauggaucgugagaaaggaagaggguaagauuuugcccuggaauuuugaacaaaaaguggauaucgagaagagugccgaagaguucauaaaacggaugaccaacaagugcacguaccugaauggggaggacgucaucccuaaagauagcuuccucuauuccgaauacauuauccugaacgagcuuaauaagguucaggugaacgacgaauuucugaaugaggaaaacaaacgaaagauuaucgacgaguuguucaaggagaauaaaaagguaucugaaaagaaguuuaaagaguaucuccuggugaaccagauagcuaaucgcacugucgaauuaaagggaauuaaggauagcuucaacucaaauuacgugaguuauaucaaauuuaaggacauuuucggcgagaaacugaaccuagauaucuacaaggagauauccgaaaagagcauccucuggaagugucuguacggcgacgauaagaaaauuuuugagaagaaaaucaagaacgaauauggggacauucuuaauaaagaugagaucaagaagauaaacucuuucaaauuuaauaccuggggaagauugucagaaaagcugcucacagguauugaguucaucaaccuggagacuggcgaaugcuacaguagcguuauggaggcauuaaggcggaccaauuauaaccugauggaacuuuuguccucuaaauuuacacuccaggagucgaucgacaaugggaacaaggaaaugaaugaggugagcuaccgcgaucugauugaggaauccuaugucucaccaagucuaaaaagagccauccugcaaacccucaagauuuacgaggaaauaaagaaaaucacgggaagggugccgaagaaaguauucauugagauggcucguggcggugacgaaacuaugaagaacaaaaagauccccgcccggcaggagcagcugaaaaagcuauaugauucuugugggaaugacauugcgaacuuuagcaucgauauaaagaaaaugaaguccucauugagcucuuacgacaauaacucccugcgacagaaaaaguuauaccucuauuaccugcaauucggcaaaugcauguauacaggaagagagaucgaccuugauaggcuguugcagaauaacgacaccuacgauauugaccacaucuauccucgcaguaagguuauuaaggaugacagcuucgauaaccucgugcugguccuuaaaaaugaaaacgcagagaagucuaaugaauacccagugaaaaaggagauccaggagaaaaugaaguccuuuuggcgguuccugaaggagaaaaacuuuauaucagacgagaaguauaaaagacucacuggcaaggaugacuucgaacugaggggguuuauggcccgccaacuugucaaugugcgacagacaaccaaagagguuggaaagauuuugcagcagaucgaacccgagaucaagauuguguacaguaaagcugagauagccagcucguuccgggaaauguuugauuucaucaagguacgugagcugaacgacacgcaccaugcaaaagacgcuuacuuaaauauugucgccgguaacguguauaauaccaaguuuacagaaaaaccuuacagauaucuccaagagaucaaggaaaacuacgauguuaaaaagauuuauaauuacgacaucaagaacgcgugggauaaagaaaauucccuggagauagugaagaaaaacaugaagaaaaauacugucaacaucaccagguucauuaaggaagagaagggccagcuuuuugaccugaauccaaucaaaaagggggaaacaucuaacgagauuaucagcauaaaacccaagcuauauaacggaaaagaagagaagcucaaugagaaguacggcuacuauaaaucacugaacccggccuacuucuuguauguggaacacaaggagaaaaauaagcgcauuaaaaguuucgaacggguaaaccugguggauguuaauaacaucaaggacgagaaguccuuagucaaauaccucaucgagaauaagaaacugguggaaccuagacuuauuaagaaaguguauaagaggcaggucauccugauaaacgauuaccccuauucuauuguugcauuggacagcaauaaacucauggauuuugagaaccugaagccacuauuccuggaaaauaaguacgagaaaauccuuaagaacgugauuaaauuucucgaagacaaucaggguaaguccgaggagaacuacaaauucaucuaucugaagaagaaagaucgauacgaaaagaaugagacuuuggaaucagugaaagaccgcuauaaccuggaguuuaacgaaauguacgauaaguucuuagagaaacucgacagcaaggacuauaagaauuacauaaacaauaaaaaguauaaaaaccugcuugauguaaaggagaaauuuauuaagcugaauuuguucgacaaggcuuuuacccucaaaaguuuccuggaucuauuuaaccggaagacaauggccgacuucucuaaagucgggcugaccaaguaccuuggcaaaauccaaaagaucuccagcaaugugcucucgaagaacgaacuguacuuguuagaggaaucaguuacuggacuguuugugaaaaagauuaaacucuga

SEQ ID NO: 3097 - RNA, 4104 nt, Artificial Sequence
  Cas9 variant
augaagaaacagcaauucagcgacuacuaucugggcuuugauaucgggaccaacuccgugggauggugcgucacagacuucaauuacaacguucucagauuuaauaagaaagauaugugggguucuaggcuuuucgacgaggccaagacugcugcagaacggcgcgugcagcgaaacucacguagaaggcugaaacggcgcaaguggagauugaauuuacuggaggaaauuuuuagugaugagauacuaaagaucgacagcaacuucuuuaggcggcucaaagaauccucucuguggcuugaggauaagucgucaaaagagaaguucacgcuguuuaaugacgauaacuauaaagacuacgauuucuauaagcaguaccccaccauuuuucacuugcgcaaugaacucaucaagaacccugagaaaaaggacauucgacugguauaucuggcccuccacagcaucuucaaaaguagaggccacuuuuuauucgaagggcagaaucugaaggauauaaagaacuucgagacacuuuacaauaacuugauggcguuucuggaggacaaugacaucuacaagaacauugauuccucuuauaucggaaaccuagaaaauauuaucugugacagcaaaaagggccucaaggauaaagagaaggaguucaaagagauauuuaacuccgacaagcaacugguggguuucuuuaaacuuucagucgggaguagcgugucucugaaugauuuguucgacacugaugaauacaagaagggagagguugagaaagaaaagauuuccuuuagggagcagaucuaugaagacgauaaaccaauuuacuauucaauccucggcgagaagaucgaguuccuggacauugcuaaaucauuuuacgauuucaugguguuaaacaauauacuggccgacagucaguauaucucugaagcaaaggucaagcucuacgacgagcauaaacgggaucuuaagaaccugaaauacauuauccguaaguauaauaaagaaaacuacgacaaguuguuuaaggauaaaaaugaguccaacuauagcgccuacauaggccuaaauaaggaaaaagggaagaaagaggugauugaaaagucgcgccugaaaaucgacgauuucgcuaagaucauuaagggauaucucccgaaagcagagaagaucgacgagaaagauagaucuauuuuuaacgaaauacuggacaagaucgagcuuaaaaccauucugcccaagcagaggaucuccgauaaugguacauugccuuaccaaauccacgaagccgagcucgagaagauucuggaaaaccaggcuaaauauuacgacuucuuaaaucaugaggaaaacggcauaucaaccaaggauaaacugcuaaugacuuucaaguuucggaucccauacuauguagggccccucaacaguuaccacaaaaauaagggaggcaacagcuggauuguucgaaaggaggaagguaaaauccugccuuggaauuucgagcagaagguggacauugagaaauccgccgaagaguuuaucaagcgcaugacaaacaaaugcaccuaucuuaauggggaagaugucauaccaaaggacucuuucuuguacagcgaguauaucauucugaacgaacucaauaagguccaggugaacgacgaguuucugaauaaagagaucaagaaaaagauuaucgaagaucuuuucaaaaagagcaaaaagauaagugagaagaacuuuagagaauaccuguuggugaaucaaauuacgaacaaaacuguugagcucaagggagugaaagacgcguucaauuccaacuauguaagcuacaucaaguuuaaagauauuuucggcgacaagcugaauuuagauaucuacaaggaaauaucugagaaaucaauccuguggaagugucuauauggcgacgauaaaaagauuuuugagaaaaagaucaagaguguguacggggacauucucaccaaagaugaaaucaagaaaauaaacagcuucaaguuuaacacauggggaaggcuguccgagaaacuuuugacugaaauugaguucaucgaccuggagaccggugaaugcuauucuucggucauggaugcacuccggcgcacaaauuacaaccugauggaguuacugagcuccaaguucacccuucaggaaaauaucgacaacgagaauaaggaagugucagaguuuaguuauagagauuugguugaggaaucuuacgugagccccucccucaaaagggccauucugcagacgcuaaagaucuaugaggaaauucguaaaauaacuggccggaucccuaagaaagucuucauugagauggcucgagggggagacgaaacaaugaagaacaagaaaaucccagccagacaagagcagcugaagaaacucuacgacucauguggcaaggauauuagcaauuuuucuaucgacauaaaagagaugaagaacucccugaauaguuacgauaacaauagccuuaggcagaaaaaguuguaucuguacuauuuacaguucgguaagugcauguacaccgggaaagaaaucgaccucaaccgccugcuucaaaauaacgauacuuaugacauugaucacaucuacccgcggucuaaggugauuaaagacgauuccuuugacaaucugguauugguucucaagaacgagaacgcagaaaaaucaaaugaguauccccugaagaaggaaauccaggagaaaaugaagaguuucuggaaauuucuaaaggagaaaaacuucauaagcgaugaaaaguacaagagacugacaggcaaagacgaguuugaacucaggggauucauggcucgccagcuggugaauguccgacagaccacgaaggaggccggcaaaauucuucaacagaucgagccugaaaucaagauuguguacucgaaagcggagauagccuccucuuuucgggaaauguucgacuucaucaagguccgugaguugaacgauacccaucacgcaaaggacgcuuaucugaauauuguggccgggaacguuuacaauacaaaauuuacugaaaagccauauagauacuuacaggagaucaaagagaacuaugaugugaagaaaauuuacaauuaugacaucaagaacgcuugggauaaagaaaagagccucgagauaguaaagaaaaauauggaaaagaacaccgucaauaucacaagguucauuaaagaggaaaagggacagcuguuugaccuuaaccccauccgcaaaggugagacuucaaaugagauuaucgccauaaagccuaaguucuacgaaggcaguaccgagaaacugaacgaaaaguacggguauuacaaaucccuaaauccagcauauuuuauuuacguggagcauaaggagaaaaacaagaucauccggucuuucgaaagaguuaaccucguggaugucaauaagauuaaagacgaaaagagccugaucaaauauuugauagaaaacaagggacugauugagcccaaagugaucaagaagguauacaaaaggcaagugauuuuaaucaauaacuuuccguauuccauaguugcccucgauucaaauaagcugauggacuucgaaaaccuuaaaccucuguuuuuggagcgaaaguacgagaaaauucucaagaaugcuaucaaauuccuggaagauaaccagggcaagacagaggaauacuauaaguuucuauaccugaaaaagaaagaccgcaaugagaagaacgaaaccaucgauagcgucaaagagcgguauaauauugaguucaacgaaauguacgacaaguuucuugagaagcucgacaguaaagauuauaagaauuacaucaacaauaaaaaguauucugaacuggugaacgugaaagagaaguucauuaaguugaaccuguucgacaaagcguuuacuuuaaaguccuuccucgaucuguuuaauagaaaaacgauggcagacuucagcaaggucggucuuacaaaauaccuggggaagauacagaagaucucgucaaacguuuugucuaaaaaugaacuccaucugcuagaggagagugugaccggccuguuugugaagaaaauuaaacuuuga

SEQ ID NO: 3098 - RNA, 4104 nt, Artificial Sequence
  Cas9 variant
augaaggacuacuaucugggccucgauauggggagcuccucugugggaugggcacuuucagacgagagauacaaccuguugagggcuaaagguaaggauuuauggggcguccggcuguucgacgaagcaaaaaccgccgcggagcgccgaacauuucguagucagagaaggcggcuagaacgcagcaaguggagacucucccugcuuacuucucuguucgaggaagagaucucgaaaauugaugacaaguuuuucgauagguugaaggacucaaaauuuuucauagaugacaagagcgaucaacagcccaauacgcucuuuaacgacguuaauuucaccgauaaagaguaucacaagcgguacccuaguaucuaucaucugcgcaacgcucuguuuaaucagaacgacaaauucgacauucgacucaucuuuuuagcccugucccacauugugaagaagagagggcauuuccuuuuugauggagacaaagcaggcuucggugaagauaucgacguaauauuggaugagcugaaggccuaccuacaggacgcuuuccacacaaaacucgaauuuacuucugaguucaagagcaucaugcuggauaaaaaucuuaggaagaaacaaaaggaggaggaacugaagaacuccauuaaaaucucaagugacaccauuaauagcaaggaugggaaaucuaucuugauaaagcucuuucugggauaugaagcaaacuuaaaaccauucuuucuggaguacaagguggaaaaggacaaugaguacaaaauuaacuucuccaaggaggauuaugaagagaaacuccuugacaugacaucaaaguuugaagagaccacuuacuucaucgaaauugccaaaaagauccaugacuauuuucuguuggaggagaucaugcuaggcuucaagaauauuagcgcuaguaaagucucuauauaccagaagcacaaaaacgaucugaagacacucaaaaauaucgugaagaaccagauuaacaauuccuauaacgccaucuuuaaggacauaggccuggauaauuacccggcguauguuagcugcuggaacucgaaaaagcacaaagaaaagcagaaaggguguaccaaggacaaauucuacgcauuucuuaagacgaagcugaaaaauauuaacaaugccaaggagaucuuggauucuaucgacaacgaugacuuccucccccggcugguggauaaaaauuccauuaucccucaucaaauucacuuagcugaacugauaaagaucauugacaaccagucacaguacuauccauuccuaaaagagaucaaggauaagaucauuaguauauuuaaauuccguauccccuuuuacgucggaccucucaauaacuuccauaaggacaaagguggcaaugccuggauugaaaagcugaaagaugagcgcaucuuuccauggaacuucaaugacgugguagaccuuaacaagagcgcagcuaacuuuauugagaagaugaucaaugaaugcuccuauuugaaaggggagaagguucuggccaaaaacucucuccuguacacuaaguauagcgugcuuaaucugauaaacaaauugaagaucaauggaaccgcggucucaguggaaacaaagcagaaaauuuacaacgagcuccuguuaaagcaaaagaauaucaagaaaacugccauuaagaaauuccugaucaacaauaguauaauugauaagaacgacgagaucuccggcauugaugacagccuaaccucuaaucucgcaguguuuaucgauuucgaaaagauaucaaacagacugagguaugaccagaaagaggauaucauuaagaguaucagccuuuuugguuacgacaaugcuauguugaaaaagcagauuaucacaauagcccccgaucuguccgaagacgagcucgaaaaacugucuaaguuacgguacucgggguucggacgacugagcaagcgccuuuugaccuccauuaaacacaacggcaagucaaucaucgagaugcucugggauacgaaugacaaccugauggagcuacugagugauagauauacuuuuauugaacaaaucaacaaacacaaugacggcuucaaggaggacauuaaccucaauuuccagaacgucgauacacuguacguuucuccuagcgugaaaaggcagauauggcaggcuuuuaagguaaucaaugaacuuauuuccgugauggggcgggagccaaagaaaaucuucgucgaaauggcccgcgaggagggagaaaagaaaagaacccaagcaaggaaggacaaaguguuggagcuguauaagucaauuaagaacaaugaaaucagcacuuucuuaacaaacuucaaagauauaaagaccaaacucgagggugaaucuaaucugaacuccaagaaacuuuaccuguauuacuugcagcucggcguugacaucuauacgggggagaagauuccguuugagaagcuguucgaucagaauaucuacgacauugaucaugugaucccccguagucugaaaaaggacgauagcuuugacaaccuaguccucaccucuaaaacaaauaacgccaagaaaacugaugaauuuccuguguccucagagauacagaguaagaugcaaaccuuuuggaaaguacugaaggacaaggaccuuaugagcgaaauuaaauacacaaauuugacucggaagacccaccugucggaugacgaguuaggagauuucaucgcucgacagcucguugagacaagacaguccaccaaagcgcugacucagauccuuaagaacguguaugcaaacucugacauugucuacgugaaagccggcauagucagcgaauuuaggcaacaguucgauaugcugaagauccgcgagcuaaaugacuuccaucacgcuaacgaugccuaucucaauauugugaucgguaacguuuacaauauuaaguuuacgaaaaacccacggaauuaugugaaggaauacuauaaaaagggggagcauuacaaccugaaaaucgaaaagauguuggagaaggacauagcaagaggcggaaauuucggcugggauaaaaagcacucaaucgagacaguacagaaaaccaugaagaaacagaguccccugauuacuuacaggaccuuugaaaacaagggggaguucuuuaaucaacagccuuccaaggccucugcuaacuuacucgcccugaaaagcuccgacaagcgccuucuggauacaguccgauauggagguuacaaaggcacccaguaugcacacauguucuugguggaacauuuuaaugggaagaucauuaaagagaucaugggaguuccaauauaccucucaaaggaaauuaaagacgauaaggcgaagcugcuagaguauuguaacgacgugcugaaacuuaagaaucccaaaauccucuucagcaagaucccguacaacagucugauugucuauaauggcuacccuaucuugcugcgggguuuaacuggggugcguggcgcugcccaacucaaacuggaccagacaucuacgcagguagugaagaacauaguuaaacuuuacgauuggcugucccagaaacaaaaggaguugagcgaccucucgaaaaagauugaauuuuuccaggagaacaauaaaaaggaugaagucaaggcagccaugcuggaggcugacaacauccuauuuauucugaaugauagauucaaaaacaccaagaucggaaaagacauaaugaaugauaaccaccuuaauaaccucuaugacacuuuuauuaauaagcuggaaaacucaaucuacaaaaauaagcccggcgggaagcaggauguguugaugaaagagaagagggacuuauuccugucuuucaguauguccaaaaagugcaucacacucuauaaaauuaucaagauuuuuggaagcugugaucaggguguggacuucucugauauagccgagaaaaucagcaaguccggcgggauuggaggcaagaaccuggguaaaaauaccuuugaccuugucuucaaggaaaacucaacauacacucugguucaaaguagcgugaccggguuguaugccaaaaagacggaccuacauaaacuguga

SEQ ID NO: 3099 - RNA, 4104 nt, Artificial Sequence
  Cas9 variant
augaagaaacagaaguucagcgacuacuaucugggcuuugauaucgggaccaacuccgugggauggugcgucacagaccucgauuacaauguucuuagauucaacaaaaaggacaugugggguucuaggcuguuugaggaagccaaaacugcugcagagcggcgcgugcaacgaaauucacguagaagguugaagcggcgcaaguggagauuaaaccugcuagaagagauuuucaguaaugaaauacucaaaaucgauagcaacuuuuucaggcggcugaaggaguccucucuuuggcuggaggacaaaucgucaaaggaaaaauuuacguuguucaaugaugacaacuauaaggauuacgacuuuuauaagcaguaccccaccauuuuccaccuccgcaaugagcugaucaaaaacccugaaaagaaagauauucgacugguauaucucgccauccauagcauauuuaagaguagaggccacuucuuauuugaggggcagaaucugaaagagaucaagaacuucgaaacacuuuacaauaacuugauugcguuccuggaggacaauggaaucaacaaaauuaucgauaagaacaauauagaaaagcuagagaaaauugugugugacuccaagaaaggccucaaggacaaagaaaaggaguuuaaggagaucuucaacucugauaaacagcuggucgcuauuuuuaaacuuagcguggguuccucaguuagucugaaugacuuguucgauacugacgaauacaaaaagggggagguggaaaaagagaagaucagcuuuagggaacaaaucuaugaggaugacaagccaauuuacuauucuauacucggagagaaaaucgaacuguuagauauugccaagaccuucuacgacuuuaugguccugaacaauauccucgcagauucccaguauauaucagaggccaaagugaaacuuuacgaggagcauaaaaaggaccugaagaacuugaaauauauuauccggaaguacaauaaaggcaacuacgauaagcuauucaaagacaagaaugaaaacaauuauagcgcuuacaucggccugaacaaagagaagaguaagaaagagguaauugaaaagucucgucucaaaaucgacgaucugauuaagaauauaaaaggguaucuuccgaagguugaggaaaucgaggagaaggacaaagcaauuuuuaacaagauccugaauaaaaucgaauugaagacaauucuccccaaacagcgcauauccgauaacggaacccugccuuaccagauccacgaggccgaauuagagaagauucuggaaaaccaaagcaaguauuacgacuuccuaaauuaugaggagaacgguaucauuacuaaagauaagcuccugaugacauuuaaauucagaaucccauacuacgugggcccccuuaauucguaucauaaggacaaagggggaaacucuuggauagucaggaaggaagagggcaagaucuugccuuggaauuuugaacagaaaguggauauugagaaguccgcugaagaguucaucaaacggaugaccaacaagugcacguaccugaauggugaggacgugauuccaaaagauacuuuccucuauucagaauacgucauccugaacgagcuuaauaagguucaggugaacgacgaauuucugaaugaggaaaacaaacgaaagauaauugaugaguuguucaaggagaauaaaaagguaagugaaaagaaguuuaaagaguaucuccuggugaagcagaucgucgacgggaccauugaauuaaagggagugaaagauagcuucaacuccaauuacaucucuuauauacgcuuuaaggacaucuucggcgagaaacugaaccuagacauuuacaaggagaucagcgaaaaaucaauucucuggaagugucuguacggcgaugacaagaaaaucuuugagaagaaaauaaagaacgaauauggggauauucuuacaaaagacgagaucaagaagaucaauacuuucaaauuuaacaauuggggaagauugagugaaaagcugcucaccgguauugaguucaucaaccuggagacaggcgaaugcuacuccagcguuauggaugccuuaaggcggaccaauuauaaccugauggagcuuuugucuucaaaauuuacgcuccaagaaaguauuaauaacgagaauaaggaaaugaacgaggcgagcuaccgcgaccugauagaggaauccuaugugucucccucgcuaaaaagagcaaucuuccagacucugaagauuuacgaggaaaucaggaagauuacagggcgugucccuaaaaagguguuuaucgagauggcccggggaggcgaugaaagcaugaaaaauaagaaaauaccagcucgacaggagcaacucaagaaacuguaugacuccugugguaacgauaucgccaauuucucaauugacaucaaggagaugaagaacagucuuauuucuuacgauaauaacagcuugagacagaaaaagcuguacuuauauuaccuccaguucgggaaaugcauguauaccggcagggaaaucgaccuggaucgccuucugcagaacaaugacacuuacgacauagaucacauuuauccgcgguccaagguaaucaaagacgauucauuugacaacuugguucucgugcugaagaaugagaacgcagaaaagagcaaugaguaccccgucaaaaaggagauccaagaaaagaugaagucuuucuggagauuucuaaaagagaagaacuucauuuccgaugaaaaguauaaaaggcugacaggaaaggacgauuuugagcuccgcggcuucauggcucgacagcuggugaauguccggcagaccacgaaagaaguggggaagauacuucagcaaaucgagccugagauuaaaaucguuuacaguaaggccgaaauugcgagcucuuuucgugagauguucgacuuuaucaaggugagagaauugaacgauacccaccaugccaaagacgcauaccugaauauaguagcuggaaacgucuauaauacaaaguucacugagaaaccauacagguauuuacaggaaaucaaggagaacuacgaugugaaaaagauuuauaauuacgacaucaaaaacgccugggacaaggaaaauucccucgaaauuguuaagaaaaacauggagaagaauaccgugaacaucacacgcuuuauaaaagaaaagaaaggucagcuguucgaucuuaaccccauuaagaagggcgagacuucaaaugaaaucaucaguauuaaaccuaaggucuauaacgggaaagacgauaagcugaaugagaaauacggauacuauaagagccuaaacccagcuuacuuccucuauguggagcacaaggagaaaaauaagcggaucaaaucguuugaaagaguaaaccugguggacguuaauaacauaaaggaugaaaaauccuuggucaaguaccugauugagaauaagaaauuaguggagcccagggugaucaagaaagucuauaagcgacagguuauucucaucaacgacuacccguauucuauagugacccuggauagcaauaaacuuauggacuucgaaaaccugaagccuuuguuucucgagaauaaauacgaaaagauucugaagaacgugaucaaauuccuagaggauaaucaaggcaagucagaagagaacuacaaauuuaucuaucugaagaaaaaggaccgcuacgagaagaacgaaacacuugagaguguaaaagaucgguauaaucucgaguucaacgaaauguacgacaaguuucuggaaaaauuggauuccaaggacuauaaaaauuacaugaacaauaagaaguaucaggagcuguuagacgucaaagagaaguucauuaaacucaaccuguuugauaaggccuucacccuuaaaucuuuucuggacuuguucaauagaaagacuauggcagauuuuagcaaggugggucucacgaaauaccuggggaagauccagaaaauuuccucaaacguucuaagcaagaaugaacuguaccuucucgaggaaagugugacaggccuguucgucaaaaagauaaaguuguga

SEQ ID NO: 3100 - RNA, 4104 nt, Artificial Sequence
  Cas9 variant
augaagaaacagaaguucagcgacuacuaucugggcuuugauaucgggaccaacuccgugggauggugcgucacagacaugaauuacaacguucucagauucaauaaaaaggauaugugggguucuaggcuuuuugaggaagccaaaacugcugcagagcggcgcgugcaacgaaacucacguagaaggcugaagcggcgcaaguggagauugaauuuacuggaagagauuuucaguaacgaaauacuaaaaaucgacagcaauuucuucaggcggcucaaggaguccucucuguggcuugaggauaaaucgucaaaggaaaaauuuacgcuguucaacgacgauaauuauaaggacuacgauuuuuauaagcaguaccccaccauuuuccacuugcgcaacgagcucaucaaaaauccugaaaagaaagacauucgacugguauaucuggccauccauagcauauuuaagaguagaggccacuuccucuuugaggggcagaacuuaaaagagaucaagaauuucgaaacacuguacaacaaucuuauugcguucuuggaggauaacggaaucaacaaauccauugacaaggauaaucuggaaaagcuagagaaaaucgugugugacucuggcaagggucucaaagacaaggaaaaagaguuuaaggagauauucaacagcgauaagcagcuggucgcuauuuuuaaacuuuccguggggcugucaguuaguuugaaugaccucuucgauacugacgaauacaagaaaggagagguggaaaaggagaaaaucagcuuuagggaacaaauuuaugaggaugacaagccaaucuacuauucuauccugggcgagaagauugaauuacuggauauagccaaauccuucuacgacuuuaugguccucaacaauauccuugcagauucacaguauauuagcgaggccaaggugaaacuguacgaggagcauaagcgggacuugaaaaaccuaaaguauaucauacguaaguacaaucgcgaaaacuacgauaaacuguucaaggacaaaaaugagaguaacuauccggcuuacauuggccucaauaaggagaaaucuaagaaagaaguaaucgagaaguccaagcugaaaaucgacgaucuuauuaagagcaucaaaggguaucugcccaagguugaagagauugaggaaaaagacaaggcaauauuuaacgagaucuugaauaagauugaacucaaaaucauccugccuaagcagagaauuucggauaacggaaccuuaccauaccagauacacgaggccgaacuggagaaaauccuagagaaucaaucuaaguauuacgacuuccucaacuaugaagagaacgguauuaucacaaaagauaagcugcuuaugaccuuuaaguucaggauucccuacuacgugggcccucuuaauuccuaucauaaagacaaagggggaaacucauggaucguccggaaagaagagggcaagauacugccauggaauuuugaacagaaaguggauaucgagaagagugcugaggaauuuauuaagcgaaugacuaacaaaugcacauaccucaauggugaggacgugauccccaaggauagcuuccuguauuccgaauacauuauccuuaacgagcugaauaaaguccagguuaacgacgaauuuuugaaugaggagaacaagcgcaaaauaauugaagaacucuucaaggggaauaaaaaggugucugaaaagaaauuuaaggaguaucuguuaguaaaccagaucaccacgggaacuauugagcugaaaggcaucaaggauagcuucaauucaaacuacauaaguuauaucaaauuuaaggacauuuucggcgaaaagcuaaaucucgauaucuacaaagagauuuccgaaaagagcauccuguggaaaugucuuuacggggacgacaagaaaauauuugagaagaagauuaaaaacgaauauggagauaucuugaccaaggacgagaucaaaaagauuaacacauucaaauuuaauaacugggguagacugucugagaagcuccugacuggcaucgaguucauuaauuuagaaaccggggaaugcuacucaagugugauggaggcccugaggcggacaaacuauaaucuuauggaauugcucagcuccaaguuuacccugcaagagaacauagauaaugagaacaaagacaucucucaguucucguaccgcgaucuagucgaagagagcuauguguccccuucacugaagagagcgauucuccagacgcugaaaaucuacgaagagauuaagaaaaucacuggaaggguuccaaagaagguguuuauagaaauggcacguggcggugacgagaguaugaaaaauaagaaaaucccggcccggcaagagcagcuuaagaaauuguaugauucuugugggaacgacauugcuaauuucagcaucgauauuaaggaaaugaaauccucacugagcuuauacgacaacaauucucuccgacagaagaagcuguaccuuuauuaccugcaguucggcaaaugcauguauacaggaagagagaucgauuuggacaggcuccugcaaaacaaugauaccuacgacauagaccacauuuauccccgcuccaaggucaucaaagaugacaguuuugauaaccuagugcugguacucaagaacgaaaaugccgagaaaagcaacgaguacccuguuaagaaggaaauccaggagaaaaugaagucuuucuggcgguuucugaaagaaaagaauuucauuuccgacgagaaauauaagagacuuacuggcaaggaugacuuugaauugaggggguucauggcacgccagcuggugaacguccgacagacaaccaaagaggugggaaagauauuacaacagaucgagccagaaauuaaaaucgucuacucaaaggcugagauugccaguagcuuucgggaaauguucgauuuuaucaaagugcgugagcucaaugacacgcaccaugcgaaggaugccuaccugaacauaguugcagguaauguguauaacaccaaguucacagaaaaacccuacagauaucuucaggagaucaaggagaauuacgacguaaagaagauuuauucguacgauaucaaaaacgcuugggacaaggaaaauucccuggagauugucaaaaagaacauggaaaagaauacugugaacaucaccagguuuauaaaagaggaaaagggccagcuauucgaccucaauccuauuaaaaagggggagacaucuaacgagaucaucagcauuaaaccaaagguuuauaauggaaaggaugacaaacugaacgaaaaguacggcuacuauaaaucauugaaccccgccuacuuccuguauguggagcacaaggagaaaaauaagcgcaucaagaguuuugaacgggucaacuuaguggauguaaauaacauaaaagacgagaagucccucauuaaauaccugguggaaaauaagaaacuuguugagccgagagucaucaagaagguguauaaaaggcaagugauucugaucaacgauuacccuuauucuauagucgcuuuggacagcaauaagcucauggauuucgaaaaccugaaaccccuauuucuggagcgaaaguacgagaaaauucuuaagaauguuaucaaauuccucgaagacaaccaggguaaguccgaggaaaauuacaaguuuaucuaucugaaaaagaaagaucgcuacgagaagaacgaaacuuuggagucagugcgggaaagauauaauauugaguucaacgagauguacgacaaauuucuggaaaaguuaaauagcaaggauuauaaaaacuacaucaacaauaagaaauaucaggaccuccuggaugugaaggagaaauucauuaaguugaaccuguuugacaaggccuucaccuugaaaaguuuucucgaccuguucaauaggaagacaauggcagauuuuucuaaaguagggcuaaccaaguaccugggcaaaauacagaagaucuccagcaacguccuuucgaagaaugaacucuaccuguuggaggaaucagugacuggauuauucguuaaaaagauugagcuguga

SEQ ID NO: 3101 - RNA, 4104 nt, Artificial Sequence
  Cas9 variant
auggugaagaaaaaguacgccaucggcauugacauagggaccaacagcgucggaugguccguugugacagaugacuauaaaguacccucuaagaaaaugaagguguucgguaauacugagaagagauacaucaaaaagaaccugcucggcacgcuucuguuugaugaagggaauaccgcugagaacaggcgguugaaacgcacagcacgacguagauauacuaggcggcgcaauagaauuuuauaccugcaggaaaucuucgccgaggaaauuaacaagaucgacgauucauuuuuccaaaggcuagacgauaguuuucucauagucgaggacaaacagggaagcaagcacccuaucuucggcacccugcaggaggaaaaggaguaucauaaacaguuuccaacaauuuaccaccuucggaagcaacuggcggauuccucucagaaagcugacauccgcuugauuuaucucgcccuggcacauaucauaaaguaccgaggucacuuccuguuugaaggggaucucaaaucggagaauaaggacgugcagcauuuauucaacgauuuuguugagauguucgacaaaaccguggaaggaucauaccugagcgagaaucuuccgaacgucgccgacguguugguagaaaagguuaguaaguccagaaggcuggagaauauucuacacuauuuucccaacgaaaagaagaauggccucuucggcaacuuccugacucuugcucugggguugcagccuaauuuuaaaacaaacuucgagcucgcagaggaugccaagauccaauuuucuaaagaaaccuacgaggaagaccuggaggaauuacugggaaagauuggugaugacuaugcugaucucuucaucgccacgaaaagccuuuacgacggcauccuguuggcggggauucuauccacuaccgauucaacaacuaaagcaccacugaguagcucuauggugaaccgguaugaggagcaccagaaggaccucgcccugcuuaaaaauuuuauacaucagaaccuguccgauucauacaaggaagucuucaaugacaaauugaaggauggauaugcuggcuacaucgaggguaagaccacacaggaaaacuuuuaccguuucauuaaaaaggccaucgagaaaauagaagggagcaauuauuuuauugacaagaucgaccgcgaggauuuccucagaaaacaaaggaccuuugacaacggaaguaucccccaccagauucaucugcaggagaugcacgcaaucauucggcgacaagcugaauuuuacccuuuucugguggagaaucaggauaagauagaaaagauccugacguuccgcauuccauauuacgugggcccccuagccagaggcaaaucugaguucgcguggcucaacaggaaguccgacgagaaaauccggccuuggaauuuugaugaaauggucgacaaggagacuagcgccgaaaacuucaucacacgcaugaccaauuaugaucaguaccugccagaccagaaaguucuuccgaagcacucguugcuguaugagaaauuugcaguguacaacgaacucacuaagguaagauacgugacagagcaagggaagucuuucuuuuucgaugcuaauaugaaacaggagauuuuugacggagucuucaagguguauaggaaaguuaccaaggaaaaacugauggauuuucuugguaaggaguucgacgaauuucguauaguggaucuguugggccucgacaaggacaacaaauccuucaaugccucacuggggacguaccaugauuuaaagaaaaucgucaguaaggaccugcuagauaaccccgagaacgaagacauucucgagaaugugguacugacccuuacauuguuugaggaucgggaaaugauccgaaaaagacuggagaaguauaaggacguucucacugaggaacagaggaaaaagcuggaacgccggcacuacaccggauggggcagauuaagcgcuaaacugauuaacgguaucagggauaaggugacacgcaaaacuauacuugacuauuugaucgaugacgggaccuccaaucgaaacuucaugcagcucauuaaugaugacacacugucuuucgucgaugagauccggcuagcccaaggcagcggagaggcagaagacuaccgugccgaggugcagaaccuggcuggcaguccugcgauuaagaaggggauccuccagucacugaaaauagucgacgaacuuauugaggugaugggauaugauccagagcauaucguuguggaaauggcaagagagaaucaguuuaccaaccaagguaggcgcaauucccagcagcgguacaagaaaauugaaaacgccaucaagaauuuggacagcaacuuaaauucuaaaauauuaaaggaguaccccacuaacaaucaggcucuccaaaacgauagacuguuccuuuauuaccugcagaacggcaaagacauguauacggaugaagaguuggacaucgaucagcucucacaauacgacauugaucacaucauuccucaggccuuuaucaaggacgauagucuggacaauaagguacuaacaaaaagcgcaaagaacagggggaaauccgacgaugucccaucucuggagauagugcauaagaaaaagaauuucuggaagcagcuccuggacucgcagcuuauuagccaacgaaaauuugauaacuugaccaaggccgaacgcggaggccugacuaaugaggacaaagcucgguucauccagagacaguuaguugaaaccaggcagaucacaaagcacguggcccguauucucgauacccgcuuuaacacuaaacuggacgaggcagguaaucggaucagagaucccaaggucaacauuauaacacuuaaguccaaucuggugucacaauucaggaaagacuaucagcuauacaagguacgagaaaucaacaauuaucaccaugcgcacgaugcuuaccucaacgccgugguugcaacggcccuguugaaaaaguacccgcagcuggcuccugaguuugucuauggggacuaccccaaauauaauaguuacaagucucgcaagagcgccaccgagaaaguguuauucuauuccaacauuaugaauuucuuccggagagugcucgucuacucaaagacuggcgaaguuaggauccggccagugauugaggugaacaaagaaacaggagagaucguaugggauaagaaaagcgacuuccgaaccgucagaaaggugcugucuuauccucagguuaacguggucaagaaaguggaaaugcaaacaggcggguuuuccaaggagaguauacuucagcauggagauagcgacaaacugaucccccgcaagacugagaaauucuacuuggacaccaagaaauacgguggcuuugauucuccaacgauugcauauuccguucuccugaucgcugacauugaaaaggggaaggccaaaaagcuaaaaagggugaaggagcugaucggaauaaccauuauggaacguauggcguucgagaaaaaucccaucgaguuucuugaacacaagggcuacaagaacauccucgagaaaaauauuauaaagcugccuaaauauucauuguucgaacuggagaacggucggagaagguuacucgccagugcuaaggaacugcagaaagggaaugagaugauccuuccaccgcaccugguaacauugcucuaccauagcucgaacauucacaagaucacugagcccauucaucugaauuaugucaacaagaauaaacacgaauuuaaggagcuacugcgccauaucuccgauuucucuacccgauacauacuugcacaagacagacucagcaaaaucgaggaacuguaugauaagaacgacggcgaugacauuucagauuugacaaguuccuuugugaauuuacugacuuucaccgccaucggagcuccugccgcauuuaaauuccucggcucugugauugaccggaagagguacacgagcaucgcggaaauacuggaggccacacuuauucaccaguccgucaccgggcuguacgagacucgcaucgauuugucaaagcuaggaggcgacuga

SEQ ID NO: 3102 - RNA, 4104 nt, Artificial Sequence
  Cas9 variant
auggugaagaaaaaguacgccaucggcauugacauagggaccaacagcgucggaugguccguugugacagaugacuauaaaguacccucuaagaaaaugaagguguucgguaauacugagaagagauacaucaaaaagaaccugcucggcacgcuucuguuugaugaagggaauaccgcugagaacaggcgguugaaacgcacagcacgacguagauauacuaggcggcgcaauagaauuuuauaccugcaggaaaucuucgccgaggaaauuaacaagaucgacgauucauuuuuccaaaggcuagacgauaguuuucucauagucgaggacaaacagggaagcaagcacccuaucuucggcacccugcaggaggaaaaggaguaucauaaacaguuuccaacaauuuaccaccuucggaagcaacuggcggauuccucucagaaagcugacauccgcuugauuuaucucgcccuggcacauaucauaaaguaccgaggucacuuccuguuugaaggggaucucaaaucggagaauaaggacgugcagcauuuauucaacgauuuuguugagauguucgacaaaaccguggaaggaucauaccugagcgagaaucuuccgaacgucgccgacguguugguagaaaagguuaguaaguccagaaggcuggagaauauucuacacuauuuucccaacgagaaaaagaauggccucuucggcaacuuccuggcucuugcacugggguugcagccuaauuuuaaaacuaacuucgagcucgccgaggaugcuaagauccaauuuucuaaagaaacauacgaggaagaccuggaggaauuacugggaaagauuggugaugacuaugccgaucucuucaucgcgaccaagagccuuuacgacggcauccuguuggcagggauucuauccacgacugauucaaccacaaaagccccacugaguagcucuauggugaaccgguaugaggagcaccagaaggaccucgcucugcuuaaaaauuuuauacaucagaaccuguccgauucauacaaggaagucuucaaugacaaauugaaggauggauaugccggcuacaucgaggguaagacuacccaggaaaacuuuuaccguuucauuaaaaaggcaaucgagaaaauagaagggagcaauuauuuuauugacaagaucgaccgcgaggauuuccucagaaaacaaaggacauuugacaacggaaguaucccccaccagauucaucugcaggagaugcacgcuaucauucggcgacaagccgaauuuuacccuuuucugguggagaaucaggauaagauagaaaagauccugaccuuccgcauuccauauuacgugggcccccuagcgagaggcaaaucugaguucgccuggcucaacaggaaguccgacgagaaaauccggccuuggaauuuugaugaaauggucgacaaggagacgagcgcagaaaacuucaucacucgcaugacaaauuaugaucaguaccugccagaccagaaaguucuuccgaagcacucguugcuguaugagaaauuugcuguguacaacgaacucaccaagguaagauacgugacugagcaagggaagucuuucuuuuucgaugccaauaugaaacaggagauuuuugacggagucuucaagguguauaggaaaguuacaaaggaaaaacugauggauuuucuugguaaggaguucgacgaauuucguauaguggaucuguugggccucgacaaggacaacaaauccuucaaugcuucacuggggaccuaccaugauuuaaagaaaaucgucaguaaggaccugcuagauaaccccgagaacgaagacauucucgagaaugugguacugacgcuuaccuuguuugaggaucgggaaaugauccgaaaaagacuggagaaguauaaggacguucucacagaagaacagaggaaaaagcuggaacgccggcacuacacuggauggggcagauuaagcgccaaacugauuaacgguaucagggauaaggugacccgcaaaacaauacuugacuauuugaucgaugacgggacuuccaaucgaaacuucaugcagcucauuaaugaugacacccugucuuucgucgaugagauccggcuagcacaaggcagcggagaggccgaagacuaccgugcugaggugcagaaccuggcgggcaguccugcaauuaagaaggggauccuccagucacugaaaauagucgacgaacuuauugaggugaugggauaugauccagagcauaucguuguggaaauggccagagagaaucaguuuacaaaccaagguaggcgcaauucccagcagcgguacaagaaaauugaaaacgcuaucaagaauuuggacagcaacuuaaauucuaaaauauuaaaggaguaccccaccaacaaucaggcccuccaaaacgauagacuguuccuuuauuaccugcagaacggcaaagacauguauacugaugaagaguuggacaucgaucagcucucacaauacgacauugaucacaucauuccucaggcauuuaucaaggacgauagucuggacaauaagguacuaacgaaaagcgccaagaacagggggaaauccgacgaugucccaucucuggagauagugcauaagaaaaagaauuucuggaagcagcuccuggacucgcagcuuauuagccaacgaaaauuugauaacuugacaaaggcugaacgcggaggccugaccaaugaggacaaagcccgguucauccagagacaguuaguugaaacuaggcagaucaccaagcacguggcacguauucucgauacacgcuuuaacaccaaacuggacgaggcggguaaucggaucagagaucccaaggucaacauuauaacucuuaaguccaaucuggugucacaauucaggaaagacuaucagcuauacaagguacgagaaaucaacaauuaucaccaugcucacgaugccuaccucaacgcagugguugccacagcucuguugaaaaaguacccgcagcuggccccugaguuugucuauggggacuaccccaaauauaauaguuacaagucucgcaagagcgcaacggagaaaguguuauucuauuccaacauuaugaauuucuuccggagagugcucgucuacucaaagaccggcgaaguuaggauccggccagugauugaggugaacaaagaaacuggagagaucguaugggauaagaaaagcgacuuccgaacagucagaaaggugcugucuuauccucagguuaacguggucaagaaaguggaaaugcaaaccggcggguuuuccaaggagaguauacuucagcauggagauagcgacaaacugaucccccgcaagacagagaaauucuacuuggacacuaagaaauacgguggcuuugauucuccaaccauugcuuauuccguucuccugaucgccgacauugaaaaggggaaggcgaaaaagcuaaaaagggugaaggagcugaucggaauaacgauuauggaacguauggccuucgagaaaaaucccaucgaguuucuugaacacaagggcuacaagaacauccucgagaaaaauauuauaaagcugccuaaauauucauuguucgaacuggagaacggucggagaagguuacucgcuagugcaaaggaacugcagaaagggaaugagaugauccuuccaccgcaccugguaaccuugcucuaccauagcucgaacauucacaagaucacagagcccauucaucugaauuaugucaacaagaauaaacacgaauuuaaggagcuacugcgccauaucuccgauuucucuacucgauacauacuugcccaagacagacucagcaaaaucgaggaacuguaugauaagaacgacggcgaugacauuucagauuugaccaguuccuuugugaauuuacugacauucacugcuaucggagccccugcagcguuuaaauuccucggcucugugauugaccggaagagguacaccagcaucgccgaaauacuggaggcuacgcuuauucaccaguccgucacagggcuguacgagacccgcaucgauuugucaaagcuaggaggcgacuga

SEQ ID NO: 3103 - RNA, 4107 nt, Artificial Sequence
  Cas9 variant
auggacaagaaauacagcaucggccuggauauugggaccuccucuauaggauucgugggugucgacgagaacggcuggccccucaauaucaaggggaaaagagccauuggagcucaccuuuuuagggaaggcgaggcagccgcggaaacacgggguuuccgcacuacgcgacguagauauaacaggcggaaguggcgccugagauuguuaagggagaucuuugaugaaccuauuucacggguugacccaaccuucuuugcucgcaugaaagagaguagcguguccccgaaggaucccaauuacgacgggcuggccaaggagauccuaauaccucgagauaaagacggaaagauccucuauccaacaauuuaccaucugagacacgcacuuauguaugaagaucaucaguucgacaucagggagauuuaccuggccauccaccauauaguaaaauaucggggccacuuuuugcucgauggcgcugcaaagaacuucgaaucuucgaaucuggaccugaaaucagauauucacgagaucaacgccauucucguggggaucuuuggaaaugagcaaguccaguucaacgaccaguacguggaaaaguuaaaggagguucugcuugacagcacucagagucguuccgaucgccaaaaagcugccgcgaagguguugcugcccaccaaugaccuagauaaagacacaaccaagauccucaaaacugucucuacagaaauuaccaaggcaauaacgggucugaaagccaaguuuuucgugaucacuggcaacgauauugcuaaggaccagcagaaagauuggaccuuuagcaucgacacacuugaugagaagauguccguaauagaaccuucauucagugagaaaaauuucagccugauuacuaucuugcagaagcucuacucuuccguuacccuggccgggaucgugccaaacggauuaucacugagcgaggcaaugauucaaaaauaugacagacaugcuagugaucucguccuucugaagaaguacugggacacaaaacccaagguguugaaacaccagcuacagaauaccuaugccgaauacaucgagauucaucagguggucgacgaauuuuauucugaucuguccaagcucauuaaaaacgacgaugacacgcuggcgcaagagaucaagagcaagauuacuaucggcaauuuccuuccuaaacagaggacaaccgaaaacgguguuaucccauaccagcugcaacagcgggaguuggauacuauuauaaagaaccagcaggaguauuacccguggcucgccgaagagaaucccguggcagaccaccaaaucgcuuuuccuuacaaacuggaugaauuaguaggguuccgaauaccauauuacgugggacccaugaucgccaaggaggacacaucgaacucuaaaaauuccaaguuugcuuggaugauucgcaagcagucaggcgaagucaccccuuggaacuucgaugagaaaaucgacagaacggccagugcaaccgccuuuauagauaggaugacaacuaccgacacauaucugaucggcgaggaugugcuaccaaagcagagccucauuuaccagcgguucgaaguucugaaugagcuuaacaaaaucuccauugacgggcaacccaucacucgcaagcagaaacagucuguguauacccacgucuuugaaaagaaaaagacagugcagguaaaggacguucaaaaauucuuggugagcucaggagaggucaugagucugccgaagauagguggccucgcuaaugagaaacaguuuaacuccagccugucuacccuuuacgauuauaauaagauuaucccugacgcgcuggaagauagaaacaaaguggacgauauugagaagaucauauuguggucaacuaucuucgaagacaauaguauuuuugucgagaagcucgauagcaucgacuggcugacguccucucagaggaaacguuuagcacagaagcgguaccgaggguggggaagacugucgcuaaggcuccugacaaccuucaaaaacaaggauggcuacagcauucuugacgaauuguggaacuccaaucauaauuucauggagauccaagcccagucagauuuuagugagcagauagcuacugccaacaacaauaaccugucucaagugcuccccgcaaaaugggaaccaggucgcaagaaucuggccagcuuagacgaguucauuuccaaccuguauaccucaccucagaauaagaaagcucuacggaaggccaucagaguugugcaggauaugaugacagcagcggggcacaugcccgagaaaaucuuuauugaaguagcuagggacaccagcaacucucaucagcaaacuaucgcccgccagcgacaguugcagcaacucuaccaguccgaagcaaaggaggucauugacaguagcgugcggucugagcuggaugacauacuuaaaaaucgugccaacaucaaggaucagcuguuccucuauuuucagcaaggcggaagagaccuguacacaggcaaggcuauuaauaucgauaaacuuuccuuguaucacauugaccauauccugccacagucauuaguuaaggaugacagucucgauaacagggugcuggucagccagaaaacgaaugaagacaagggggugaccuucguaucggauaaauacaugaacaauaugcuucccacuuggaagcgcuggcacgagaugggacugauauccgcccggaaauugaagaaccucacaaugagaccugacgaaaucgacaaguaugcaccagguuuuauucaaaggcagcugguggagacccgacagguuacaaaacuugucaucgaacugcucgaugcucugcuuggcaauucucagacugagauuaucaccauaaaggccagcuugucacaccaauuccgccagcaguuugaccuggugaaaauucgggaggugaacgauaaccaucacgcguucgacgccuuuuuagcugcaagaaucgggacguaccucuacaagagguauccgaaacugcgucccuacuucgucuauggacaguacaugcaaaaucauaagaaccuuaagaguaucaaucugauuaaaacccuagauuccgacaaggccauaguugaugaaggcacaggugagauccucugggacaaaaagucugaucuggcuaaaaugauuaagaucuauaacuaccagcgcuugcugauuacucacgaaagccggaccuccuuuggggccauguauaagcagaaaaucuuaaaggcaacagacgcgaaacagaauggcggaggcuucaagcucgugccuacuaaaagaaacuggccaguggauauauacgggggauacaccggucaaacggccgcuuaucugacaaucguaagggucuacucaaagaagaccagcgagcuucgagugcugcccauuuauacuaauaaaguucagcagaucgagaaggccaugacacagggcgacaaagcaaccauguuggcuuucaagaaagugauugccccucaacucgggaaggaaaacaagaaaacucacgagaucaagauaccagaauuugaugucgugauucccaaaguucugcuagaccagcuggugaucgacgauaucgcaggaaguccgcaucgguuccgccuuggcaccgacacauacuaucacaauucucagcaacucuuucugccuuuguccaugcagagacagcugauggauagggagagcgacgauaagguauacuuagacauuuucaacgauguccucaaacagguggacucguauuuuaaucuguacgaugugaacgguuuccgggccgcucuacaaaagucuaaaaaggcguuugaacagcugccaaucaaugacuuccccaaggaugucccugacaacaaaaagaaaaaggggaaacgaucaauauugaaggagauuuuuaucggccuccaugccaaugcaacgcugggaaaccuaaagcagaugggcauuaaaaccgauuucgggaagcugcagaaaaguaacggacuuagaaucacugagaauugcaagauaauucaccaaucccccacaggccucuuugaacgcaucguuccaaucaaauga

SEQ ID NO: 3104 - RNA, 4107 nt, Artificial Sequence
  Cas9 variant
augagcagacccuacaacaucggccuggacauugggaccuccucuauaggauggucaguggucgaugaccagaguaagcucguuagcgugagggguaaauauggcuacgggguacggcuuuaugaugagggacaaacagccgcugaacgccgauccuuccguacuacgagaaggcggcugaagcgcagaaaauggagguugggcuuacugcgggagaucuuugaaccuuacauuaccccaguggacgauacauucuuucuacgccagaagcagucuaaucucucgccgaaagaccagcgaaagcuguauccccaaacuucacuuuucaacgauagaaccgacagggcauuuuacgaugacuauccuacaaucuaccacuugcgguacaaguugaugaccgagaaacgucaguucgauauucgcgaaaucuaucucgccaugcaucacauagucaaguacagaggucauuuucugaaugaggcgccagugagcaguuucaaauccucugagaucaaccugguugcucacuuugacaggcucaauacuauuuucgccgauuuauuuagcgaauccggguuccagcuggagacagacaaacuugcagaagugaaagccuugcugcuagacaaccagcaaucagcuaguaaucggcagcgacaggcacucagccugaucuauacccccucuacgaacaaggccgucgagaagcagaauaaagcuauugccacugagcuucugaaggcgaucuugggacucaaagcaaaguuuaacgugcugaccggcauagaagccgaggauguaaaggcuuggacauuaacuuucaaugccgaaaacuucgacgaggaaaugguuaagcuggaguccucacucgaugacaaugcacaucaaauuaucgagagccuucaggaacuguacaguggcguguugcuagcugggauugucccugagaaccagucucugucccaagccaugaucaccaaauaugaugaccaccagaagcaccucaagaugcugaaagcggugcgcgaagcccuugcaccagaggauagacagaggcugaagcaggcuuacgaccaauauguggauggacaggaaaauacaaaagccuacagcaaggaggacuuuuacggugauaucaccaaggcuuugaaaaacaaccccgaccauccuauugucucggagauaaagaaacucaucgaacuggaccaguucaugccaaagcagcggacgaaagauaauggcgccauuccgcaccaauuacaucagcaggagcuggaccgcaucauagaaaaccagcaacaguauuaccccuggcuagcagagcucaauccuaacucuaagagacagacuguugccaaauauaagcuggaugaacuuguggcuuuuaggguaccauacuauguggggcccuugauuacagcggagcagcaacgucaguccucagacgcaaaguucgccuggcugauccggaaagcugagggacgaaucaccccuuggaauuuugaugacaaggucgauagacaggccagugcaaacgaguucauuaaaaggaugacuacaaccgacacguaccuccuggccgaggaugugcuuccaaagcaaagccugaucuaucagcgcuuugaaguuuugaaugagcucaacggccugaaaauugacgaucagcccauaaccacagaguuaaagcaggcuaucuucacugaccuguuuaugcaaaagauuuccgugaccgucaaaaauauccaggauuaccuagugucugaaaagcgguacgccagcagaccggcaaucacaggucucucagacgagaacaaauucaauaguaggcuguccacuuaucacgaccuuaagaugauuguaggggaugcgguugacgauguggacaaacaggcugauuuggaaaagugcauagaguggagcaccaucuuugaagacggaaaaauuuacucugccaagcugaacgagaucgauuggcucacagaccagcaacgcguccagcuggcagccaagcgauaucggggcuggggccguuuaucagcuaaacugcuuacccagauugugaaugccaacgggcagagaaucauggauuugcucugggacacuacggauaauuucaugaggauaguccacagugaggacuuugauaagcugaucacagaagcaaaccaaaugaugcuagcugagaacgacgugcaggacguuauuaaugaucuguacaccagcccucagaacaaaaaggcccuccgccaaauccugcuugugguaaaugacauucagaaagcgaugaagggacaggcccccgaacggaucuugauagaguucgcuagagaagaugaggucaacccaaggcuguccgugcagcgaaagcgccaaguugaacagguguaucagaauauuucuaacgaauuacucaauaacacugagauccggaaugaacugaaagaccuuucgaacagcgcacuguccaauaccagauuguuccucuacuuuaugcaggguggcagggauauguauacaggggacucacugaacauugaucgucuaaguaccuacgacaucgaucauauacugccucaaucuuucgucaaggacaauagccucgauaaccgcgugcugguaucccagaaaaugaaucggucaaaggccgaccaggugcccacugacuuuacaagcguugagcuuggcaaaaagaugcaguugcaaugggaacagaugcugagagcuggauuaaucacgaagaaaaaguacgauaaccucacccugaacccagaccacauuucuaaauaugccaugaaggguuucaucaauaggcagcuugucgagacucgacaggugauuaaacuggcaacaaaccuacucauggagcaauacggggaagauaauaucgagcugauaaccgugaaguccggcuugacacaucagaugcggacugaauuugacuuccccaagaaccgcaaucugaacaaucaccaucacgcguuugaugccuauuuaaccgcuuucgucggacucuaccugcuuaaaagauauccuaagcugaaaccauacuuuguuuauggcgaguaccagaaggccagucaacaggacaaauggaggaacuucaauuuucugaacgggcucaagaaagaugagcugguggacgaaaauacggaggcagugauuugggauaaggaaagcggacuagcuuaccugaacaagaucuaucaguucaaaaagauccuuguaacccgggagguccacgaaaauucuggugcccucuuuaaccagacacuguacgcagccaaagacgauaaggcuuccggccaagggggaaaacaguugauuccggcgaagcaggaccgacccacugcccuguauggcgguuacucagggaagaccagugcauauuuaugucucgugaaaaucaagaauaaaagcgaguacauuuauagaauauucggcguuaacacaucgugguccucugagcugaagcagauccaagauccugcugaacgccuugugaggcuggagaaauugcucacuccacagcugaccauuaacaagaagaaaaagggagaacccgucccugugacgaaagacuucaagaucauucuaccacguauccugauaaaucagaaauuuuacagccggggccaggacaucucaauugccagugaguucuaccuucauaacgaacaagagcucguucuggauaaguccgacaucaagauuuugaauggggccaucaaagugaacaauucuaacaagcagguaauaaauuuauuuaaccacauucuggagcaggucaaucaauauuuccccguguacgauaucuauaaaagcagagaagugcucaacuccucaaaggagaucuuugaaaaucugacauggaacgaccaguggaggaaucgcaaacuuauuaacgucggacagaagaccauacugaaucgaaucuugauuggucuacaugcuaacgcagccagaaucaagauuagcgagcugggcuucaaaaaugauuuugggcuccugacucagacaaguggaaucaccuucacuccggacacccaaauaaucuaccagucuccuacaggccuuuuugaacggaggguugcguuacgcgaucuguga

SEQ ID NO: 3105 - RNA, 4107 nt, Artificial Sequence
  Cas9 variant
augaagagaagcuacaacaucggccuggacauugggaccaauuccauaggaugggccaucguggaugaccagucuaaacucauuucagucaaggguaaauauggcuacgggguuaggcuuuaugaugagggacaaacagcugcagaacggcgcaguuuccgaacuacgcguagaaggcugaagcggcgcaaauggagauugggcuuacugagggagaucuuugaacccuacauuaccccuaucgacagcacauucuuucuacggcagaagcaguccaaccucucuccaaaggaucagcgcaaacuguauccgcaaacuucgcuuuucaaugaccgacccgaugccgacuuuuaccagcaguauccuaccauauaccaccugagauaccaguugaugacagagaagaggcaauucgauauccgggaaauuuaucucgcgaugcaucacaucgugaaauaccguggucauuuucugaacgaggcuccaguagccucauucaagagcagugagauuaaucuggcagaacacuuugaccagcucaacaccaucuucgccgauuuauuucgcgaguccggguuccagcuggaaacugacgagcuuguggcugucaaagcauugcugauggauaaucagcaaucugccagcaacagacagaggaaggcucuacccaagcucuauacaccuuccgccgacaaaucaauagagaagcagcggaaagcgauugcaaccgaaauccugaaggccauucuuggacugaaagcuaaguuuaaugugguuacgggcaucgaggccgaagacgugaaagcaugggcuuugacuuucaacgccgagaauuucgaugaagaacucgcgaagcuggagaguagcuuagacgauaacggccaugaagucaucgggauucugcaagagcucuacucuggaauacuucuggccgguaucgugccagaaaaucaguccuugucacaggcaaugauuaccaaguaugaggaacaccaggcucaccuaaaaaugcugaaggccguacgagacgaucucgcuacagccgaccaacagaaacugaagaaagcauacgaucaguauaucgacggccaggagaacacuaaggccuacagcaaggaggcuuuuuacgaugacguuaccaaagcgcuuaaggauuauagugaacaaccccuggugucugagauacagaaauugauugaacucgaccaguucaugccuaagcagcgcacaaaagacaauggggcaaucccacaucaacugcaccagcaggaguuagauagaaucauugaaaaccagcaacaguacuauccguggcuggccgagcuaaaccccaauccuaagaggcagaccgucgcuaaguacaaacucgacgagcugguggccuuucgggugccauauuacgucggaccccuuaucacggcagaacaacagcagcaguccagcaacgccaaguucgcuuggaugauucgcaaaacugagggcagaauaacaccuuggaauuuugaugacaagguugauaggcaagccucggcaaacgaguucaucaaacguaugaccacuacagacaccuauuugcuggcggaggaugugcucccaaagcagucucugauuuaccagcgguuugagguacuuaaugaacugaacgguuugaagaucgacgaucagcccaucacgaaugagcucaaacaagcuauuuucaacgaccuguuuaugcagaagaccuccgugucagucaaaaauauacaggauuacuuagugagugaaaagcgauaugccagcagaccggcaaucacagggcuguccgacgagaaaaaguucaacucuaggcuaagcacuuaccaugaucucaaaguuauugugggagacgccgucgacgauguggacaagcaggcugaucuggaaaagugcaucgaguggucaaccauuuuugaggacggcaaaaucuauagugccaaacuuaaugaaauaacaugguugacugagcaacagcgcggccagcuggcaaccaaacgguacagaggguggggaaggcucuccgcuaagcuguuaacacaaaucguaaacgccaauggucagcgcauuauggaucugcuuugggacaccacugauaacuucaugcgaaucguucacuuugaagacuucgauaaauugauuacggaggcgaaucagauggugcucgccgaaaacgacguccaggaugugaucaacgaccuguauacaagcccucaaaauaagaaggcucuacggcagauacugcucgucgugaacgauauucagaaagcaaugaagggccaggcccccgagcguauccugauugaguucgcuagaggggcccaaaaagacaagucucuuaccguuaggcgcaaacggaaguuggacgaaauguacucacagaucagugaugcagugcuggcggacgagagcguaagacaggaauuaaaguccucuaaucaggaugaccucgucaaagagaagguguaucuguacuuuaugcaaggaggcagggaucuuuacacugguaacgcccugaauauagaccgauugucggauuaucacguugaccauaucauuccacaggcuuacaucaaagaugacagccucgauaacaaggcccugguguccucacgcaugaaugaaauuaaagcagaccgggucccucuacaggugguacagaagcaauucgggaagaacauggcuagugaguggggcuauaugcacagagccggacugaucucuaggaaaaaguacgacaaucucauguuuaaccccgagaaucugaacaaauaucagauaaaucguuucauuagccgccagcuuguggaaacccaacagguuaucaaguuggucgcaaaccuguuauccaaucaguacgagggcgauaacgugaaaaucauuacagugaagucaaaacucacccagacuauccggagcgaauuugacuucccaaagaacagagaggucaauaacuaucaucacgccuuugaugcuuaccugacagcguucguugggauguaccuucugaagagguaucccaaacuaucuuccuacuuuacguauggagaguaccucaaggguaaucaacaggacaaauggaguagcuucaacuuucugaaugauuugaagcgagccaaacuggaagacaagaccaacaaggagauuuucuggcauaaagaaucuggcuuagcauaucucaauaagauauaccaguuuaaaaagauccuggugacucgggaggugcacgaaaacuccggggcucuuuucaaucagacacuguaugccgccaaagaugacaaggcuucaggacaaggcgguaagcaguugauuccugcaaaacaggcccgcccaaccgcgcucuacgggggcuacaguggaaagacaguagcuuauauguguaucgucagaauuaaaaacaagaaaggcgaucuguacaaggugugcgggguugagacuagcuggcuagcccagcugaagcaacuuaaagacgaggauucgcagaaggcauuccucaaacagaagaucuccccgcaauuuaccaaagccaagaagcagaaaggaacgauagugaaggucguggaagacuucgagguuaucgcuccccacauucugaucaaucagagguuguuugauaacggucaggaacugaccuuaggcucugcaacauauaaacauaaugagcaagaacucauucuggacaagacugccgugaaacuucugaacggggaguugccucucgcgcagagcgaggaacuggcugagcuaguauacgacgaaauccuggaucaggucaugcacuauuucccacuuuacgacaccaaucaguuucgggccaagcuccuggcaggaaaaacagccuucaugcaauugcccuggaagucaaacccugaugacaacaagacugugcagauaacccagccaauuguguuaaagaagauccugcagggccuccaugcugaugccggucgagucagucugaaagagcuugggaugacgacagacuuuggcaugcugcaaaaggcaaccggaaucacuuucacacccgauacccagauuauauaucaguccccgacuggcuuguuugaaagacgcguugcucuaagggaccuguga

SEQ ID NO: 3106 - RNA, 4107 nt, Artificial Sequence
  Cas9 variant
auggacaagaaauacagcaucggccuggauauugggaccaacuccgugggaugggccgucauaacagacgauuauaagguucccucuaaaaaguucaaagugcucgguaauacugacagacacucaaucaagaagaaccuuauuggcgcucuguuguuugauaguggggagacggcagaagccaccagguuaaaacggacagcgcgccgacguuacacuagaaggaagaaucggaucugcuaucugcaggagauuuucagcaacgaaauggcuaaaguagacgauuccuuuuuccaucgccuagaggaaucuuuucucguggaggaggacaagaaacacgaaagacauccuaucuucggaaauauagucgaugagguggccuaccacgaaaaguauccaaccaucuaccaucugaggaagaaacuuguugacucgacagauaaggcagaccugcgguugauuuaucucgcccuggcucacaugaucaaauuucgcggccacuuccugauugagggugaucucaacccggacaauucagacguggauaaguuauuuauccaacugguccagaccuacaaccagcuuuucgaggaaaaucccauaaacgcaagcgggguggacgccaaagcuauuuugagugcccgacuguccaagucuagaaggcuagagaaucucaucgcgcagcugccuggagaaaagaagaacggccuuuuuggcaaucugauugcauugagccucgggcugacuccaaacuucaaguccaauuuugauuuagccgaggacgcuaaacugcaacucucaaaggauacauacgacgaugaccuugauaaccuguuggcccagaucggagaccaguaugcagaucuauuccuggcugccaaaaaccucagugacgcgauccugcuuagcgacauucugcggguaaauaccgaaauaacgaaggcccccuugucugcauccaugaucaaacguuacgaugagcaucaccaggaccucacucuguuaaaggcucugguucgccaacagcuaccugagaaguauaaagaaauuuucuuugaucagucaaagaacgguuacgccggcuauaucgacgggggagcuagccaggaggaguucuacaaauuuauaaagccaauucucgagaaaauggauggcaccgaagaacugcuugugaaguugaauagagaggaccugcucaggaagcaacggacauucgauaacgguaguaucccccaucagauccaccugggggaacuucacgccauucugcgacgccaggaggacuuuuauccuuucuugaaagauaauagagaaaagaucgagaaaauucucacuuuuaggauaccauacuacgucggaccgcuggcacggggcaacucucgcuucgccuggaugaccagaaaguccgaagagacaaucacccccuggaauuuugaggaagugguggacaaaggcgcuagcgcgcaaucguucauugagaggaugacgaacuuugauaagaauuuaccuaacgaaaagguccugccaaaacauucucuacucuaugaguacuucacuguuuauaaugagcugacaaaggugaaauacguaaccgaagggaugcguaagcccgcauuucuuuccggagagcagaaaaaggccaucguggacuugcuguucaaaacuaaccggaaggucacagugaagcagcucaaagaagauuauuucaagaaaaucgaguguuuugacucaguugaaauuagugguguggaggaccgauucaaugcuagccugggcaccuaccacgauuuacugaagauaaucaaagacaaggauuuucuugacaacgaggaaaaugaggauauuuuggaagacaucguccucacgcugacccuauucgaggauagagaaaugauugaggagaggcugaagacauaugcccaucucuuugacgauaaagugaugaagcagcugaaacgccggagauacacuggguggggaaggcuuucccgcaaguugaucaacggcauacgagacaaacaaucugguaagaccauccuggauuucuuaaagagcgacggguuugcaaaccggaauuucaugcagcucauucacgaugacucacugacauuuaaagaagacauccagaaggcccagguaaguggccaaggagauucccuucaugagcacauugcuaaccuggccggcagcccugcaaucaaaaaggggauauugcagacuguuaaaguggucgacgaacucgugaaggucaugggacgucacaagccagagaauauugugaucgaaauggcgagagagaaccagaccacacagaaaggucaaaagaacucuagggagcgcaugaaacggauugaagagggcaucaaggaacuggggucacagauacuaaaagagcaucccguugagaauacccagcugcagaaugaaaagcucuaccuguauuaccuucaaaacggaagagauauguauguggaccaggaguuggauaucaauaggcugagugacuacgauguagaccacauugucccgcagagcuucuuaaaagaugacuccaucgauaacaaggugcucacucgaucugacaagaaucgcggcaaaucggacaacguuccuagcgaagagguggucaagaaaaugaagaauuauuggcggcaacugcuuaacgcuaaacugauuacgcagagaaaguuugauaaucuaacaaaggccgaaaggggugggcucuccgagcuggacaaagcaggcuucaucaagcgucaguugguggagacccgccagauaacuaaacauguagcccaaauucuggauucacggaugaacaccaaguacgacgaaaacgauaaauuaaucagagaggugaagguuaucacacucaagaguaaacuggucucugacuuuaggaaggauuuccaguucuauaaagugcgagaaauuaauaacuaccaccacgcucaugacgccuaccuuaaugcaguggucggaaccgcucugaucaagaaauaucccaaguuggagagcgaauuuguuuacggcgauuauaagguguacgacgugcggaaaaugauugccaaguccgagcaggagauagggaaagcgacugccaaguauuucuuuuacucaaacaucaugaauuucuuuaaaacagaaauuacgcucgcuaacggagagauccgcaagagaccacugauugaaaccaauggugagacuggcgaaaucguaugggauaaggggagggacuucgcaacaguccggaaagugcuaagcaugccucagguuaacauagugaagaaaaccgagguccaaacaggaggcuuuucuaaggaguccauccugcccaaacgaaauagugauaaacuuauugcccgcaaaaaggacugggacccaaagaaauaugguggguucgauagccccacuguggcuuacucuguucucgugguagccaaggucgaaaaaggcaaguccaaaaagcugaagucagugaaagaguugcugggaaucaccauuauggaaagaaguagcuuugagaagaacccuaucgacuucuuagaggcaaaaggcuacaaggaagugaaaaaggaucucauaauuaagcugccaaaauauucgcuuuuugagcuggaaaaugggaggaagcguauguuggcguccgccggagagcuccagaaaggcaacgaacuggcucuaccgucuaaguacgucaauuuccuguaucuugccagccacuacgagaaacucaaggguucacccgaggacaacgaacagaagcagcuguucguugagcaacauaaacacuauuuggaugaaaucaucgagcagauuagugaauuuuccaagcgggugauauuagcagacgcuaaucuggauaaaguacucucugccuacaacaagcauagagacaaaccuaucagggagcaggcagagaacauuauccaccuguucacgcuuaccaaucugggggccccagcugcguuuaaguauuucgauacaacuauugaccgcaaacgauacaccagcacaaaggaaguguuggaugccacucuaauccaccaauccauaaccggacuguacgagacgagaaucgaccucucacagcugggcggugauuga

SEQ ID NO: 3107 - RNA, 4107 nt, Artificial Sequence
  Cas9 variant
auggacaagaaauacagcaucggccuggauauugggaccaacuccgugggaugggccgucauaacagacgauuauaagguucccucuaaaaagcucaaaggucuuggcaauacugacagacacgggaucaagaagaaccugauuggagcuuuguuauucgauucaggcgagacggcagaagccaccaggcugaaacggacagcgcgccgacguuacacuagaaggaagaaucggaucugcuaucuacaggagauuuuuaguaacgaaauggcuaaaguggacgauagcuucuuucaucgccucgaggaauccuuccugguagaggaggacaagaaacacgaaagacauccuaucuuugguaauauaguggaugaggucgccuaccacgaaaaguauccaaccaucuaccaucuuaggaagaaacuggcagacucuacagauaagguggacuugcggcucauuuaucuggcccuggcucacaugaucaaauuccgcgggcacuuucucauugagggagauuuaaacccggacaauucggacguugauaagcuguucauccaacuugugcagaccuacaaccaguuguuugaggaaaaucccauaaacgcaucacgagucgacgccaaagcuauucugagcgccagacuaaguaaguccaggcggcucgagaaucugaucgcgcagcuuccuggcgaaaagaagaacggccuguucgggaauuugauugcacucucucugggauuaacuccaaacuuuaagagcaauuucgaucuggccgaggacgcuaaacuccaacuuuccaaggauacauacgacgaugaccuggauaacuugcuagcccagaucggugaccaguaugcagaucuguuucucgcugccaaaaaccugucagacgcgacccuucugagugacaucuugcgugugaauagcgaaauuacgaaggcaccccucucugccuccaugauaaaacgcuacgaugagcaucaccaggaccugacuuuacugaaggcucuaguaagacaacagcucccugagaaguauaaagaaaucuucuucgaucagucaaagaacggcuacgccggguauauugacggaggcgcuagccaggaggaauuuuacaaauucaucaagccaauacuggagaaaauggaugguaccgaggaacuuuuggccaagcugaauagggaggaccuccugcggaagcaacgaacauuugauaacgggaguauucccuaucagauccaucuuggagaacugcacgcaaucuugcgcagacaggaggacuucuacccuuuucucaaagauaauagggaaaagauugagaaaauccugacuuuccggauuccauacuauguuggcccguuagcccgcggcaacucuagauuugcuuggaugaccaggaaguccgaagagacaauaacccccuggaauuucgaggaaguggucgacaaaggggcgagcgcacaaucguuuaucgagcguaugacgaacuucgauaagaaucugccuaacgaaaaggugcuaccaaaacacucucuccuguacgaguauuuuacuguguacaaugagcuuacaaaggucaaauauguuaccgaaggaaugcggaagcccgccuucuuguccggugagcagaaaaaggcuauuguggaccugcucuuuaaaacuaaccgaaagguaacagugaagcagcugaaagaagauuacuucaagaaaaucgaguguuucgacucagucgaaaucaguggcguggaggacagauuuaaugccagcuuagggaccuaucaugaucugcuuaagauuauaaaagacaaggauuucuuggacaacgaggaaaaugaggauauccucgaagacauuguucugacgcuaacccuguuugaggauagggaaaugaucgaggagcgccucaagacauacgcacaccuguucgacgauaaagugaugaagcagcuuaaacggagaagguacacuggauggggccgcuugucccgaaagcugauuaacgguauccgggacaaacaaucugggaagaccauauuagauuuucucaagagcgacggcuucgccaaccguaauuuuaugcagcugauccaugaugacucacuuacauucaaagaagacauucagaaggcucaggucaguggacaaggcgauucccugcacgagcauaucgccaacuuggcagggagcccugcgauuaaaaagggaauccuccagacugugaaaguaguugacgaacuggugaaggucauggguagacacaagccagagaauauagugauugaaauggcuagggagaaccagaccacacagaaaggccaaaagaacucucgcgagcggaugaaaagaaucgaagaggggauuaaggaacuaggaucagauauccugaaagaguaucccgucgagaauacccagcuccagaaugaaaagcuguaccuuuauuacuugcagaacggcagggacauguauguggaucaagagcuggacauaaaucgauuaagugauuacgacguugaucacaucgugccgcagagcuuucucaaagacgauuccauugacaacaagguacugacucgcucugacaagaaucgggguaaaucggauaacgucccuagcgaagaggugguuaagaaaaugaagaauuauuggagacagcuucugaacgccaaacuaaucacgcaaaggaaguucgacaaucucacaaaggcagaacgugggggccuguccgaguuggauaaagugggauuuauuaagcgccagcuggucgagacccggcagaucacuaaacauguggcccagauauuagacucaagaaugaacaccaaguacgaugaaaacgacaaacucauuagggagguacgagugaucacacugaagaguaaacuuguuucugauuuccggaaagacuuucaauucuacaagguccgcgaaaucaauaacuaucaccaugcucacgaugccuaccugaaugcaguggugggcaccgcuuugauuaaaaaguaucccaaacucgagagcgaauuugucuacggggacuauaagguuuacgaugugagaaagaugaucgccaaauccgagcaggagauuggaaaggcgacugccaaauauuucuucuacucaaacauaaugaacuuuuucaagacagaaaucacgcuggcuaauggugagauuaggaaacggccacuaaucgaaaccaauggcgagacuggggaaauugugugggacaagggacgagauuuugcaacaguaagaaagguccugagcaugccucaggugaacaucguuaaaaagaccgaggugcagacaggcgguuucucuaaagaguccauacuucccaagcgcaauagugacaaacucaucgccaggaagaaagacugggauccaaagaaguacgggggcuuugacagccccacugucgcuuauucugugcugguuguggccaaaguagaaaagggaaaauccaagaaauugaagucagucaaggagcuguuaggcauuaccaucauggaacguaguagcuucgagaaagauccuauugacuuucucgaggcaaagggguacaaagaagugcggaaggaucugaucauaaaacuuccaaaguauucgcuguucgaguuggaaaacggaagaaagaggaugcucgcguccgccggcgagcugcaaaaagguaaugaacuagcucugccgucuaaguacgugaacuuucuuuaucucgccagccacuacgagaaacugaaggggucacccgaggacaaugaacagaaacaguuguucgucgagcagcauaagcacuauuuagaugaaauuaucgagcaaaucagugaguucuccaagcgcguuauucuggcagacgcuaaccucgauaaagugcugucugccuacaauaagcaucgagacaaaccuauaagagaacaggcagagaacaucauucaccuuuuuacgcugaccaacuugggagccccagcugcguucaaguacuuugauacaacuaucgaccggaaaagguauaccagcacaaaggaaguacuagaugccacucugauucaucaguccaucaccggccucuacgagacgcgcauagaccugucacaacuugguggcgacuga

SEQ ID NO: 3108 - RNA, 4107 nt, Artificial Sequence
  Cas9 variant
auggacaagaaauacagcaucggccuggauauugggaccaacuccgugggaugggccgucauaacagacgauuauaagguucccucuaaaaaguucaaagugcucgguaauacugacagacacucaaucaagaagaaccuuauuggcgcucuguuguuugauaguggggagacggcagaagccaccagguuaaaacggacagcgcgccgacguuacacuagaaggaagaaucggaucugcuaucugcaggagauuuucagcaacgaaauggcuaaaguagacgauuccuuuuuccaucgccuagaggaaucuuuucucguggaggaggacaagaaacacgaaagacauccuaucuucggaaauauagucgaugagguggccuaccacgaaaaguauccaaccaucuaccaucugaggaagaaacuugcagacucgacagauaaggccgaccugcgguugauuuaucucgcucuggcacacaugaucaaauuucgcggccacuuccugauugagggugaucucaacccggacaauucagacguugauaaguuauuuauccaacuggugcagaccuacaaccagcuuuucgaggaaaaucccauaaacgccagccgagucgacgcuaaagccauuuugagugcgagacuguccaagucuaggcggcuagagaaucucaucgcacagcugccuggggaaaaacguaacggacuuuuuggcaaucugauugccuugagccucggccugacuccaaacuucaaguccaauuuugauuuagcugaggacgccaagcugcaacucucaaaagauacauacgacgaugaccuugauaaccuguuggcacagaucggggaccaguaugcugaucuauuccuggccgcgaagaaccucagugacgccauccugcuuagcgacauucugcgcguaaauucugaaauaaccaaagcacccuuguccgcuucaaugaucaagagauacgaugagcaucaccaggaccucacgcuguuaaaagcccuggugaggcaacagcuaccugagaaguauaaggaaauuuucuuugaucagagcaaaaacggauacgcugguuauaucgacggcggggccagucaggaggaguucuacaaguuuauaaaaccaauucucgaaaagauggauggaacugaggaacugcuugcaaaauugaaucgggaggaccugcuccgaaagcaacgcaccuucgauaacggcucuaucccccaucagauccaccugggugaacuucacgccauucugagaaggcaggaggacuuuuauccuuucuugaaggauaaucgggaaaagaucgagaagauucucacauuucgcauaccauacuacguugggccgcuggcuagaggaaacuccagguucgcguggaugacucguaaaagcgaagagaccaucacacccuggaauuuugaggaaguggucgacaagggcgcaucggcccaaucuuucauugagcggaugaccaacuuugauaaaaauuuaccuaacgaaaaggugcugccaaagcauucccuacucuaugaguacuucacgguguauaaugagcugacuaaagucaaguacguuacagaaggcaugcgaaaacccgaguuucuuucaggggaacagaagaaagcuaucguggacuugcuguucaagaccaacagaaaaguaacugugaagcagcucaaggaggauuauuucaaaaagaucgaauguuuugacagugucgagauuagcggaguggaggacagguucaaugccucccuggguacauaccacgauuuacugaaaauaaucaaggacaaagauuuucuugacaacgaagagaaugaagauauuuuggaggacaucguucucacccugacgcuauucgaagaucgcgagaugauugaggaacggcugaagaccuaugcacaucucuuugacgauaaggugaugaaacagcugaagagaaggcgcuacacaggcugggggcgacuuucucggaaauugaucaacggaauacgugacaagcaaagcggcaaaacuauccuggauuucuuaaagucagacgguuuugccaacagaaauuucaugcagcucauucacgaugacagucugaccuuuaaggaggacauccagaaagcucaggucuccgggcaaggcgauagccuucaugaacacauugccaaccuggcaggaucuccugcgaucaagaaaggcauauugcagacagugaagguaguugacgagcucgugaaagucauggggaggcacaagccagaaaauauugugaucgagauggcucgcgagaaccagacuacccagaagggacagaaaaauucacgggaaagaaugaagaggauugaggaagguaucaaagagcugggcagugauauacuaaaggaguaccccgucgaaaacacacagcugcagaaugagaaacucuaucuguacuaucuucagaacgggcgagacauguacguggaucaagaauuggacaucaaucgccugagcgauuaugacguugaucauauugugccgcaguccuucaucaaggacgauucuauugacaacaaaguauuaacccggucggacaagaauagaggaaagagcgauaacgucccuuccgaggaagugguuaaaaagaugaaaaauuacuggaagcagcuccugaacgccaaacuuaucacucaaaggaaguuugacaaucugacgaaggcagagcguggcggucuaucagagcucgauaaagccggguucauaaagcgccagcugguggaaacacggcagauuaccaaacacgucgcucagaucuuggacaguagaaugaacacuaaguaugaugagaacgacaaacugaucagggaagugaagguaauuaccuuaaagucuaaacucgugagcgauuuucgaaaggacuuccaauucuacaaaguucgggagaucaauaacuaccaucacgcccacgaugcauaucugaaugcugucgugggcacagcccuuauuaagaaauaccccaagcuggaauccgaguuuguguauggagacuacaaggucuaugauguucgcaaaaugauagcgaagucagagcaggaaaucggcaaagccaccgcuaaguacuucuuuuauagcaacauuaugaauuucuuuaaaacugagaucacauuggcaaacggggaaauuagaaagaggccacucaucgagacgaauggagaaaccggugagauagugugggacaagggccgggauuucgccacugugcgaaaaguacugucuaugccucaggucaacaucgugaagaaaacagagguucagaccgggggauuuuccaaggaaaguauucuacccaaaagaaauagcgacaagcugaucgcucgcaaaaaggacugggauccaaagaaauacggcgguuucgacucucccacaguggccuacuccguccuugugguugcaaagguggagaaagggaagaguaaaaagcucaagucaguaaaagaacuguugggcauuacuaucauggagaggagcucguuugagaagaacccuauagauuuccuggaagcgaaaggauauaaggagguccguaaagacuuaauuaucaagcucccaaaguacucccuguuugaacuugagaauggccggaaaagaaugcuggccucugcuggggaauugcaaaagggaaacgagcucgcccugccgagcaaauaugugaauuuccuauaccuggcaucacauuaugagaaacuuaaaggcagucccgaagauaacgagcagaagcaacucuucguggaacagcacaagcauuaccuggacgagaucauugaacaaauauccgaguuuucuaaaagggucaucuuggcugaugccaauuuagacaagguucugagcgcauauaacaaacaccgcgauaagccuauucgagagcaggccgaaaacaucauucaucucuucacccugacgaauuuuggugcuccagcggccuucaucuacuuugacaccacaauagggagaaaccgguacaaauccaucaaggaggugcuugaugcaacucugauucaccagucaaucaccggauuguaugaaacaaggauugaccuaagccaacugggcggugauuga

SEQ ID NO: 3109 - RNA, 4107 nt, Artificial Sequence
  Cas9 variant
augaaguacgagagcgaagaguauuacaucggccuggacauggggaccuccucugugggaugggccgucacagauccccacuaucaucucauuagaaagaaggguaaagaccuuuggggcgcuaggcuguucgaaaaggcaaacacugcccaggagcggcgcacgaaucgaauaaaccguagaaggaaucaacggcgcaaacagagaaucgcguuuauuagggaggcuuuccggaaggagguugagaagguggauguaaacuuuuuccgccgauuggacgaaucacaguuauaccuggaggauaaaaguaucaaggaaccuuaucuacucuuuaaugaccugaacuacaccgauaaagacuucuaucaccaguacccaacaguguuucaucuuauuacugaucuguugaccagcgacagaaaguucgauaucagggagauauacaucgccgucuccucucucuauaaucaccgggggaacuuucugaauaaaucgcugggaaacgagacacaagacgaagaucucguguucaagaauuuagacgaggcauuuucagccugcggcaugaacuggaauaccaaggcugaaaacauugagguugugaaacagauccugugugaccguagccuuaauaagaaagaaaagcaggaucaguuggcacauugccuggagauuaacaaaaagacugagaaagaaaagaucgaguuccuaaagcuccugacaggugggaaagccgacaguaagaaaauguuuccgcaauaccacuaugaacgcgaugagaaacuuuccuucgcuuucgccgacgaaaacggagaugagaauugggaggaaacccugaacgcgauagaggaaagauugacgucugacgaguacggccucauucuggcauuaaaaagcgucuaugauugguccauccuggccgaccucaugaagaaugaaaagacuggcgagaccuaccccuaucuuucaauggcuaggaaagauaguuacgagaagcacaaagccgaccugcgguugcuaaagagcgugauuaaacgacugaucccuaacgaauacaaucauuucuuccgccaguaugaugggaagggaaagacauacacuaacuauaucgguucuguacaguaccacgagaaaagacauagguuuaagcacauuaccacaaaagaauuuuaugacggccucaagaaacugcuuaagccauacuccgaggacgaggaaauaaagcagauccugcaagauauugagucagaaaccuuuuugcccaaacagaucacgaauaugaacgggguuauaccuaaucaggugcacgcaaaggagcucaaagucauucuggaaaaggcuagccaacauuaugacuucuuaaacgagacuaaugagaguggacugacagugaaagaacagaucaugcagauguuuaccuuccagaucccauacuacgugggcccccuagccaaccucaaugguaaggggaacggaugggcgguccgguauguuggcaaagagcgcacuaagguguacccuuggaauauggaugaaguaauugacgagaaggaaacagccgaucaauuuaucaaaagaaugauuucuaccuguacguaucugggcgacgaguacgugcuuccaaaguccagcauauuguaugagaaauucgcaguccugaacgaacucaacucgcugaagaucaaugggcagccggugucuguugaucuuaaacagaagauuuacagggaccuguuuaccaagggaaaacgugugacacagaaggguuugcuccuguauuuaaaacgggagggcgucaucuccaagucagaagagacuauccugaguggguucgauauugacuuuaaaaacacccuaagcuccuaccgaaaguucugcgaaguguucgcuacaaaugagcucaacgaugagcaaauaagaauggccgaagacaucauugaguggcugacuguauuuggagauucuaagaaauucguuagggaaaagauccacggcaauuacccccagauuaccgcuaaccagcuuaaacgcaucuugagcuuuaauuucaaggacugggguaaacugucaaagcaguuucucgagcuggagggggaagaccgggagacaggcaagaguuguuccuuaauacaagcccugugggauaccaacaauaaccuuaaucaguugcucagcucuagauucacuuauaaagaaaaccuggagaagaaaaggaagaaaaucgaaauggaccuauuugaguucacgcaugaggaucuggacgaucucuacauuucagcaccugugaagcgcaugaucuggcaggcccugaaaauuaugaaggacaucgucauagugaugaaggaaaguccaacaaaacuuuuuauugagaugacccgaaauaacgaaaaugagaagacucggaccgucagccguaaaaacaaguugguggaucuguauaaaaagaucaagggagaauccagagacuggauuaaagaguuagagagguacgaagagaaggauuuccgcucuaaaaagcucuaucuguacuauacacagaugggcaaaucggcuuacagcggggaacccaucgacauggauaaacuuuuugacaagaacguuuacgauauagaccacaucuauccuaaguccaaggugaaagacgauucacuguugaauaacugcguacucgucaagcggaaagagaauauggacaagggaaacaauuucccaauugaucccgacauccaaaccaagcaggaacaucuguggaaauuuuggcuagagaagggucugauuacucaggagaaauucaacagacucacaaggaagaaaccguucacgaaugaugaacuggcggacuuugugaaccgacaacuuguugagaccggccaggcaacuaagacaaucgccgauuuguucaagaugaccuuuccuaauagugacauaguguacgucaaagcugggaacgugacagauuuccgccaguauauugaaguauacaagugucgggaggugaauaaccugcaccacgccuaugacgcauacuuaaauguugucgugggaaacguguaugauacuaaauuuaccaagaaucccaugaacuacaucaaagagcagagaaaggaaaacucuaaugagagguaccauauggacaaaaucuucgaauuuccagucauucguaacggcaaggaggccuggaucacgaagaaagacgaaagcauuaauauaguucgcaagacccucgcucggaaaacaccucuggugacuaagagaaacuucgaggccaaugguaccaucgcaaaagcgacaauuuaucccaaggggaacgugaaggaucaaggcuaccuuccaaggaaaacuuccauccccgcucugcgagacaugaagaaauauggaggcguaaccucaauucagaucgccuacuuuuuccuagucgagcacgaagugaagaaaaagcggauacgcacgaucgagugcguuccuauuuauagaaaggaagaacucaaaacaaaggaacagcuggagagguacugucgggaggaauugaaacugaucaauccaagcauucgauuagagaagaucaaaccguauucucuccugaagaugaacgggaacuuuuucuacauaaccggaaagacuaaugauagauucucccuugcaaaugccauggaacuguacguggacaaagucagugagaaccauauucgcgauuuggugaaguauaaaaauugcgguuacuuuaacguugacgauaaggaagcuaggaaacguaaugagcggcucuauacaauccugaccaagaaacaccuaacuguguucaagggcagccccaagccuaugggggagaaacugcagcaauaccagcagcuuuuucucgaacuggagguaucuaagcaggucuauguguugcugcaaaucuuacagcucaccgccacaaacgugaaaacgaaggcagaccugaccgcuauuggaggcaaagccaaugaagguacuauggauauauccaagaaccuugagaacgucaucaagaaucagauuaaaaaggggcugguuccagaguugaugcucaucaaccaaucacccacaggccuguucgaaagugagauugaccuacugaccaucuga

SEQ ID NO: 3110 - RNA, 4107 nt, Artificial Sequence
  Cas9 variant
augagcagacccuacaacaucggccuggacauugggaccuccucuauaggauggucaguggucgaugaccagaguaagcucguuagcgugagggguaaauauggcuacgggguacggcuuuaugaugagggacaaacagccgcugaacgccgauccuuccguacuacgagaaggcggcugaagcgcagaaaauggagguugggcuuacugcgggagaucuuugaaccuuacauuaccccaguggacgauacauucuuucuacgcaagaaacagucuaaucucucgccgaaggaccagcgaaagcuguauccccagacuucacuuuucaacgauagaaccgacagggcauuuuacgaugacuauccuacaaucuaccaucugcgguacaaauugaugaccgagaagcgucaauucgauauucgcgaaaucuaucucgccaugcaccacauagucaaauacagaggucauuuucugaaugaggcgccagugagcaguuucaaguccucugagaucaaccugguugcucacuuugacaggcucaauacuauuuucgccgauuuauuuagcgaauccggguuccagcuggagacagacaaacuugcagaagugaaggccuugcugcuagacaaccaucagucagcuaguaaucggcagcgacaagcacuccugcuuaucuauacccccagcacgaacaaggccgucgagaaacagaauaaggcuauugccacugagcuguugaaagcgauccucggacugaaggcaaaauuuaacguguuaaccggcauagaagccgaggauguaaagacauggacucugaccuucaaugcugaaaacuucgacgaggaaaugguuaaacucgagucuucccuugaugacaaugcccaccagauuaucgagucacugcaggaauuguacagcggcgugcuacuggcagggauugucccugagaaccaaagucucucucaggcuaugaucacaaaguaugaugaccaccagaagcaucugaaaaugcuuaaggccgugcgcgaagcgcuggccccagaggauagacaaagguugaaacaggcauacgaccaguauguggauggacaggaaaauaccaaggcuuacuccaaagaggacuuuuacggugauaucacgaaggcccucaagaacaaccccgaccacccuauugucagcgagauaaagaagcugaucgaauuagaccaauucaugccaaaacagcggacuaaggauaauggcgcuauuccgcaucagcugcaccagcaagagcuagaccgcaucauagaaaaccagcagcaguauuaccccuggcucgccgagcugaauccuaacucgaaaagacaaacaguugcaaaguauaaacuugaugaauugguggccuuuaggguaccauacuauguggggccccugauuaccgcugagcagcagcagcaaucuuccgacgcgaaauucgcauggaugauccguaaggccgagggacagaucacuccuuggaauuuugaugacaaagucgaucggcaggcuucagccaacgaguucauuaagcgaaugacaaccacggacaccuaccuccuggcagaggaugugcuuccaaaacaaagucugaucuaucagagauuugaaguuuugaaugagcucaacggccugaagauugacgaucagcccauaacaacugaguuaaagcaggccaucuucaccgaccuguuuaugcagaaaacaagcgugacugucaagaauauucaggauuaccuaguguccgaaaagagguacgcuucucgcccggccaucaccggucucagcgacgagaacaaguucaauucacggcugaguacauaucacgaccuuaaaaccaucguaggggaugcaguugacgauguggacaagcaggcggauuuggaaaaaugcauugagugguccacuauauuugaagacggaaagaucuacagcgcuaagcugaacgagauugauuggcucacggaccagcaaagaguccagcuggccgcaaaaagguaucgcggcuggggccgauuaucugccaagcugcuuacacagaucgugaaugcuaacgggcagcggauuauggauuugcucugggacaccacugauaauuucaugcguaucguccauucagaggacuuugauaaacugauaaccgaagccaaccaaaugaugcuagcagagaacgacgugcaggacguuaucaaugaucuguacacaaguccucagaacaagaaagcucucagacaaauucugcuugugguaaaugacauccagaaggccaugaagggacaggcgcccgaaaggauuuugaucgaguucgcccgcgaagaugaggucaacccacggcugagcgugcagagaaaaaggcaaguugaacagguguaucagaauauauccaacgaauuacucaauaacaccgagauucgaaaugaacugaaggaccuuucuaacucggcucugagcaauacucgcuuguuccucuacuuuaugcaggguggccgggauauguauacaggggacucccugaacaucgauagacuaucaacguacgacauugaucacauccugccucaaaguuucauaaaagacaauucucucgauaacaggguccuggugagccagcguaugaaucgcuccaaggcagaccagguacccaccgacuuuacuucaguggagcuuggacagaaaaugcaaauccagugggaacagauguugcgggccggccugauuacaaagaagaaauacgauaacuuaacccucaacccagaccauaucagcaaguaugcuaugaaagguuucauuaauagacagcugguugagacaaggcaagucaucaaacuugccacuaaccugcuaauggagcaguacggggaagauaauauagagcucauuaccgugaaaucuggccugacgcaccagaugcgaaccgaauuugacuuccccaagaaccggaauuugaacaaucaucaccacgcauuugaugcguaucugacagccuucgugggauuauaccuccugaagcgcuauccuaaacuuaagccauacuuugucuauggcgaguaccaaaaggcuucccagcaggacaaguggagaaacuucaauuuucugaacggguugaaaaaggaugagcucguugacgaaaauacugaggccgugaucuggaacaaagaaaguggacuggcauaccuaaauaagaucuaucaguucaagaaaauucuggugaccagggagguacaugaaaacagcggugcucuuuuuaaucaaacacucuacgccgcaaaggaugacaaagccucuggccaagggggaaagcagcugaucccggcuaaacaggaucggcccacugcguuguauggcgguuacuccgggaagaccgucgccuauauguguauugugcgaauaaagaacaaaaagggcgaccuguacaaaguuugcggaguggagacgucaugguuagcacaacucaagcagcugacagaugaggacaguaaaaaggcuuuccuuaagcagaaaaucagcccucaguucaccaaggucaaaaagcaaaaaggcacuauugugaagguuguggaagacuuugagguaaucgccccacacauucugaucaaccagagauucuuugauaaugggcaggaauugacacucggaucggccaccuauaagcauaacgagcaagaacugauacuagacaaaacugcugucaagcugcuuaauggugcacucccccugacccaguccgaggaguuggccgaacagguguacgaugagaucuuagaccaggugaugcacuacuucccucuguaugauacaaaccaauuucgcgcgaaacucucugcuggcaaggccgcauucaugaaacugccauggaaaagccagugggacgggaauaagaugguccagguuggacagcaagugauucuugauaggguacugaucggcuugcacgccaacgcugcagugucagaccuagguguccugaaaauuaguacgccccucgggaagaugcagcagccguccggcaucucucugagcccugauacccagauaauuuaccaauccccaacuggacuuuuugaacgucggguggccuuaagagaccuguga

SEQ ID NO: 3111 - RNA, 4107 nt, Artificial Sequence
  Cas9 variant
augagcagacccuacaacaucggccuggacauugggaccuccucuauaggauggucaguggucgaugaccagaguaagcucguuagcgugagggguaaauauggcuacgggguacggcuuuaugaugagggacaaacagccgcugaacgccgauccuuccguacuacgagaaggcggcugaagcgcagaaaauggagguugggcuuacugcgggagaucuuugaaccuuacauuaccccaguggacgauacauucuuucuacgccagaagcagucuaaucucucgccgaaagaccagcgaaagcuguauccccaaacuucacuuuucaacgauagaaccgacagggcauuuuacgaugacuauccuacaaucuaccaucugcgguacaaguugaugaccgagaaacgucaguucgauauucgcgaaaucuaucucgccaugcaccacauagucaaguacagaggucauuuucugaaugaggcgccagugagcaguuucaaauccucugagaucaaccugguugcucacuuugacaggcucaauacuauuuucgccgauuuauuuagcgaauccggguuccagcuggagacagacaaacuugcagaagugaaagccuugcugcuagacaaccagcaaucagcuaguaaucggcagcgacaggcacucagccugaucuauacccccucuacgaacaaggccgucgagaagcagaauaaagcuauugccacugagcuucugaaggcgaucuugggacucaaagcaaaguuuaacgugcugacccgcauagaagccgaggauguaaaggcuuggacauuaacuuucaaugccgaaaacuucgacgaggaaaugguuaagcuggaguccucacucgaugacaaugcacaucaaauuaucgagagccuucaggaacuguacaguggcauuuugcuagcuggcaucgugccugagaaccagucucugucccaagccaugaucaugaaauaugaugaccaccagaagcaccucaagaugcugaaagcggucagagaagcccuugcaccagaggauaggcagcggcugaagcaggcuuacgaccaauauguggaugggcaggaaaauaccaaagccuacagcaaggaggacuuuuacggagauauuacaaaggcuuugaagaacaaccccgaccauccuauagugucggagaucaagaaacucauugaacuggaccaguucaugccaaagcagcgcaccaaagauaauggugccaucccgcaccaauuacaucagcaggagcuggacagaauaauugaaaaccagcaacaguauuaccccuggcuagcagagcucaauccuaacucuaagaggcagacggucgccaaauauaagcuggaugaacuuguugcuuuucgugugccauacuauguaggccccuugaucacugcggagcagcaacggcaguccucagacgcaaaguucgccuggcugauccgaaaagcugaggggagaauuacaccuuggaauuuugaugacaagguggauaggcaggccagugcaaacgaauuuaucaaacgcaugaccacuacagacaccuaccuccuggccgaggauguccuuccaaagcaaagccugauuuaucagcgguuugaaguguugaaugagcucaacggacugaaaauagacgaucagcccaucacgaccgaguuaaagcaggcuauuuucacagaccuguuuaugcaaaagacuuccguuucugugaaaaauauccaggauuaccuagucagcgaaaagagauacgccucaaggccggcaaucaccggccucagugacgagaacaaauucaauucccgccugagcacauaucacgaccuuaaggcgauugugggugaugcuguagaagacguugauaaacagguggacuuggagaagugcgucgaauggucuacuauauuugaggaugggaaaaucuacucagccaagcugaacgagauugacuggcucaccgaucagcaacgagugcagcuggcagccaagcgguaucguggauggggcagauuaagugcuaaacugcuuacacagaucgucaaugccaacggccagaggauuauggacuugcucugggauaccacugacaauuucaugcgcaucgugcacagcgaagauuuugacaagcugauaacggaggcaaaccaaaugaugcuagcugaaaacgauguucaggacgugaucaaugaccuguacacauccccucagaacaaaaaggcccuccggcaaauucugcuuguagucaaugauauccagaaagcgaugaaggggcaggcccccgagagaauuuugaucgaguucgcuagggaggacgaggugaacccacgacugucuguucagcgcaagcggcaaguggaacaggucuaucagaauauaucgaacgaguuacucaauaacaccgaaauuagaaaugagcugaaagaucuuagcaacuccgcacugucaaauacuagguuguuccucuacuuuaugcagggaggucgugacauguauaccggcgauagucugaacaucgaccgccuaucuacauacgauauugaccauauccugccucaauccuucauaaaggauaauagccucgacaaccgggugcugguaucacagaaaaugaauagaagcaaggccgaucaggugcccaccgacuuuacuucuguugaacuugggaaaaagaugcaguugcaaugggagcagaugcugagggcuggauuaaucacaaagaaaaaguacgacaaccucacgcugaacccagaucacauuuccaaauaugccaugaagggcuucaucaaucgacagcuugucgagacccgccaggugauuaaacuggcaacuaaccuacucauggaacaauacggugaggacaauaucgaacugauaacagugaagaguggguugacccaucagaugcggacagaguuugauuuccccaagaacagaaaucugaacaaucaccaucacgcguuugacgccuauuuaacugcuuucgucggccucuaccugcuuaaaagguauccuaagcugaaaccauacuuuguuuauggagaguaccagaaggccagccaacaggauaaauggcggaacuucaauuucuugaacggccucaagaaagacgaacugguggaugagaauaccgaagcagugauuugggacaaggagucugggcuagcuuaccugaacaagaucuaucaguucaaaaagauccuuguaacgcgagaaguccacgaaaauuccggagcccucuuuaaccagacccuguacgcagccaaagaugacaaggcuucaggucaaggcgggaaacaguugauuccggcgaagcaggauagacccacagcccuguauggaggcuacagugguaagacuguggcauauauguguaucguucgcauuaaaaauaagaaaggggacuuauacaaggugugcggcgucgagaccagcuggcucgcucagcugaaacaacuuacagaugaagacucgcagaaggccuuccugaagcagaaaauauccccucaguucacuaaggugaaaaagcaaaaaggaaccaucguuaaggugguagaggacuuuaaggucauugccccacauaucuugauuaaccagagguucuuugauaacggccaggaacucacgcuggggucugcuacauauaaacacaaugagcaagaacuaauccuggacaagaccgcagugaaacuucucaacggagcccugcccuugacucagagcgaggaguuagcggaacagguguacgaugagauacuggaccaggucaugcauuacuucccucucuaugauacaaaucaauuucgugcuaagcugucagccgguaaagcagccuucaugaaacuuccauggaagaguaucugggacggcaacaaaaugacccagauugggcagcagaucauucuggaucggaucuugauaggacuacacgcuaaugcagccguuuccgaccugggcgugcucaagauuucuacuccccuggguaaaaugcaacagccgagcgggaucucccuuucaccugauacccagaucauuuaccagagcccaacaggcuuauuugaaagaaggguagcgcugcgcgaccucuga

SEQ ID NO: 3112 - RNA, 4107 nt, Artificial Sequence
  Cas9 variant
augguggagaagaaaagcuacuccaucggccuggacauugggaccaacucugucggaugggccguuauaacagaugacuauaaggugcccgcuaaaaagaugaaaguacucgguaauacuucaagacagaguaucaagaagaacaugauuggcgcacuucuguucgaugaagggggaccugccgcgagcacgagggugaaacggaccacacgccgacguuacacuagaaggaagaaucgguugugcuauuuacgcgacaucuuugaguccgaaaugcacaccauugauaaacauuucuuucugagacuagaggacucuuuccuccacaagucggauaaaagguacgaagcucauccaaucuuuggcacacugcaagaggagaaggccuaucacgacaacuacccgaccauauaucaucuucggaaggcacuggccgauaauacugaaaaagcugacuugcgccucaucuaccuggcacuggcccacauuaucaaguuccgaggucacuuucucauugagggggcuuuaucagccaacaauacagauguccagcagcuggugcaugcgcuuguugacgcauacaacaucauguucgaagaggaucaguuggacauagaggccauugacgugaaagcuauccugaccgaaaagauuagcaaaacgagaaggcuagagaaucucaucaguaacauccccggacaaaagaaaaauggccuguuuggcaaccuuauugcccuguccuuggggcucacuccuaauuucaagucucacuuuaaccugccagaagaugcaaaguuacagcuggcuaaagacaccuaugaugaggaacucaauaaccuucugacacagauaggagacgaguacgccgauuuguuccuaagcgcgaagaaccuguccgacgccauccuccugucagauauucuuacugucaauggugacggcacccaggcaccccugagugcuagcuugaucaaacgguaugaggaacaucgucaagaucucgcccuguuaaagcagauguuuaaagagcagcugccugaccuauaccgcgauguguucacagacgaaaacaaggacggguaugcuggauacauaucuggcaagaccucccaggaggccuucuauaaauacauuaagccaauccucgaaacgcuggauggugcagaggacuuucuuacuaaaaucaauagagaggauuucuugaggaagcaacggacauuugacaacgggucaauuccccaccagauccaccugggagaacuccaggccauucuggagcgacaacaggcuuacuauccuuuccuuaaagauaaucaggaaaagauagagaagauccugaccuuucgcauuccauacuauaucggcccguuggcgagaggcaacagcagguucgcauggcucacucggacaagugaccagaaaaucacccccuggaauuuugaugaaaugguagaccaagaggccucugcucaggccuucauugagcgcaugacgaacuuugaugaauaccugccucaggagaagguuuuaccaaaacauucccugaccuaugaauacuucacaguguauaaugagcuaacuaaggucaaauacgugaccgaggggaugacaaagcccgaauuucucagcgcaggacagaaggagcaaauaguggaacugcuuuucaaaaaguacagaaaagucacuguuaagcaguugaaagaggacuuuuucucgaagaucgaauguuucgauaccguggacauuucugguguagaggauaaauuuaacgccucccugggcacauaucacgaccuccugaagaucauuaaggacaaggcuuucuuagauaauucagagaacgaaaauaucauagaggacaucauucugacccuuacuuuguuugaagauaaagagaugaucgccaacaggcucgcaguguacgaagaccuguucgaucagaauguccuaaaacagcugaagcgucggcauuauacgggguggggacgacucaguaaacaacugauuaacggcaugagagacaagcacacagguaagaccauccuugauuuucuaaaagcggacggguucauaaacaggaauuuuaugcagcugauuaacgaugacaaucugagcuucaaggaggagaucaaaaaggcucaggaaggcggacucaaagauuccauuaacgaccagauccgcgaucuggccggcucuccugcaauaaagaaggggauccuucaaacuauuaauaucguggacgagauuguuaaaaucaugggaaaggccccacagcauauaguggucgaaauggcucgggacgugcagaaaaccgauauugguguaaagcaaagcagagagaggaugaaacgcguucaggaagugcugaagaaguugggcucacagcuccugaaagagcaccccgucgagaacuuucagcuacaaaaugaacgacuguaccucuauuaccugcagaacgggaaggacauguauacaggagaggaacuuaguaucuccaauuugagccacuacgauaucgaccauauuaucccgcggucuuucauuaaagaugacucaauagauaacaaggugcugacccguagugagcacaauagaggcaaaacugacaacgucccuagcaucgaggugguuaagaggaugaaacccuacuggcagaaguuacucgauacaaaggugauuucccagcgcaaauuugacaaucugacgaaggccgaacggggugggcuucaagagucugauaaagcaaacuucauccagagacagcugguagaaaccaggcagauuacuaagcaugucgcucaaauccuagacucgcgauuuaauacagagcgcgacgaaaaagaucggccaauaagaagggugaagguuaucacccucaagagcaaauucguguccgacuuccgucaggauuuuggcuucuauaagcugcgcgagauuaacgacuaccaccacgcccaugaugcguauuugaacgccgucgugggaacagcucuguuaaaaauguacccuaagcucgcaucagaguuuguauauggcgacuaccagaaauaugaucugaagcggaugguggggaagaguggaaaagccucuggucacgcuacugccaaguacuucuuuuacagcaaucuuaugaacuucuuuaaauccgaaguuaagcuggcaaauggcaacaucauuaaaagaucacccaucgaggucaaugaagagaccggggaaauagugugggacaagacgaaggauuucggaaccgugaggaaagucuugagcgcgccacaaguuaacauugugaagaaaacagagauccagacuggcgguuuuucuaaugagaccauccucuccaaggggaaaaguagcaagcugauuccccgaaagaacaaauggcgggacacaacuaaguauggcggauucaauaccccuacgguggccuacucuguauuggucguggcuaaaguugaaaagggcaaagccaagaaacugaagccagugaaggagcuugucgggauaacaaucauggaacgcaccaaauuugaggcaaacccgauugcuuuccucgaauccaagggauaucaugauauccaggagcaccugaugauuacuuugcccaaauacucacuguucgaguuagaaaauggcagaaggcggcuccuggccagugcaacagagcuucagaaggguaacgaaauggugcugccucaacauuugguuaccuuucucuaucgagugagcaaaagagacaaggggacucagucggagaauauggaguacaucuccaaccacaaggaaaaauucauagagaucuuucacuauauuauccgcuacgccgaaaagaauguaauuaaaccaaaggucaucgagaggcugaacgauaccuucaaccagaaauuuaaugacucugaccuaacagaacugagcauaucauuccuuaaccucuuuaaguucacgaguuuuggagcucccgagaaguucaccuuuuuaaauuccgagauuaaacaggaugacgugcguuaccggucuacuaaggaaugcuugaacagcacauuaauccaucaauccgugaccggccuguaugagacaagaaucgaucucucacaguucgguggcgacuga

SEQ ID NO: 3113 - RNA, 4107 nt, Artificial Sequence
  Cas9 variant
auggacaagaaauacagcaucggccuggauauugggaccaacuccgugggaugggccgucauaacagacgauuauaagguucccucuaaaaaguucaaagugcucgguaauacugacagacacucaaucaagaagaaccuuauuggcgcucuguuguuugauaguggggagacggcagaagccaccagguuaaaacggacagcgcgccgacguuacacuagaaggaagaaucggaucugcuaucugcaggagauuuucagcaacgaaaucgcuaaaguagacgauuccuuuuuccaucgccuagaggaaucuuuucucguggaggaggacaagaaacacgaaagacauccuauauucggaaauaucgucgaugagguggccuaccacgaaaaguauccaaccauuuaccaucugaggaagaaacuugcagacucgacagauaaggccgaccugcgguugaucuaucucgcucuggcacacaugauuaaauuucgcggccacuuccugaucgagggugaucucaacccggacaauucagacguugauaaguuauuuauacaacuggugcagaccuacaaccagcuuuucgaggaaaaucccauuaacgccagccgagucgacgcuaaagccaucuugagugcgagacuguccaagucuaggcggcuagagaaucucauugcacagcugccuggggaaaaacguaacggacuuuuuggcaaucugaucgccuugagccucggccugacuccaaacuucaaguccaauuuugauuuagcugaggacgccaagcugcaacucucaaaagauacauacgacgaugaccuugauaaccuguuggcacagaucggggaccaguaugcugaucuauuccuggccgcgaagaaccucagugacgccauucugcuuagcgacauacugcgcgugaauaccgaaaucacgaaagcacccuugucugcuuccaugauuaagagauacgaugagcaucaccaggaccucacucuguuaaaagcccugguaaggcaacagcuaccugagaaguauaaggaaaucuucuuugaucagucaaagaacggauacgcugguuauauagacggcggggccagccaggaggaguucuacaaguuuauuaaaccaauccucgagaagauggauggaaccgaagaacugcuugcaaaauugaaucgggaggaccugcuccgaaagcaacgcacauucgauaacggcaguaucccccaucagauucaccugggugaacuucacgccauccugagaaggcaggaggacuuuuauccuuucuugaaggauaaucgggagaaaauugaaaagauacucacuuuucgcaucccauacuacguugggccgcuggcuagaggaaacucuagguucgcguggaugacccguaaauccgaagagacaauuacccccuggaauuuugaggaaguggucgacaagggcgcaagcgcccaaucguucaucgagcggaugacgaacuuugauaaaaauuuaccuaacgaaaaggugcugccaaagcauucucuacucuaugaguacuucacuguguauaaugagcugacaaaagucaaguacguuaccgaaggcaugcgaaaacccgcuuuucuuuccggggagcagaagaaagccaucguggacuugcuguucaagacuaacagaaaaguaacagugaagcagcucaaggaagauuauuucaaaaagauugaguguuuugacucagucgaaauaaguggaguggaggacagguucaaugcaagccuggguaccuaccacgauuuacugaaaaucauuaaggacaaagauuuucuugacaacgaggaaaaugaggauaucuuggaagacauuguucucacgcugacccuauucgaggaucgcgaaaugaucgaggagcggcugaagacauaugcccaucucuuugacgauaaggugaugaaacagcugaagagaaggcgcuacacuggcugggggcgacuuucccggaaauugauaaacggaauccgugacaagcaaucuggcaaaaccauucuggauuucuuaaagagcgacgguuuugcuaacagaaauuucaugcagcucauccacgaugacucacugacauuuaaggaagaccuucagaaagcccaggucagugggcaaggcgauucccugcaugagcacauugcaaacuuggcgggaagcccugcuaucaagaaaggcauacuccagacugugaagguaguugacgaacuggugaaagucauggggaggcacaagccagagaauauugugaucgaaauggcccgcgagaaccagaccacacagaagggacagaaaaauucucgggagagaaugaagaggauugaagaggguaucaaagaacuaggcucagauauacugaaggaguaccccgucgagaccacucaacuccagaacgaaaaacuguaucuuuacuauuugcagaaugggcgagacauguacguggaucaagagcuggacaucaaccgcuuaagugauuaugacguugaucauauugugccgcagagcuuccucaaggacgauuccaucgacaauaaaguacugacgcggucugacaagaacagaggaaagucggauaaugucccuagcgaagaggugguuaaaaagaugaaaaacuacuggaagcagcuucugaaugcaaaacuaauuacacaaaggaaguuugacaaccucaccaaggccgaacguggcggucuguccgaguuggauaaagcuggguucaucaagcgccagcugguggagacucggcagauaaccaaacacgucgcccagauuuuagacucaagaaugaauacaaaguaugaugaaaacgacaaacucaucagggaggugcgaguaaucacccugaagaguaaacuugugucugauuuucggaaagacuuccaauucuacaagguucgcgaaauuaacaauuaccaucacgcacacgaugcuuaucugaacgccgucgugggcacugcguugaucaaaaaguaccccaaacucgagagcgaauuuguguauggagacuacaaggucuaugauauuagaaagaugauagccaaauccgagcaggagaucggcaaggcuacagcaaaauacuucuuuuauucaaauauuaugaacuucuuuaagacggaaaucacccuggccaauggggagauuaggaaacggccacuaaucgaaacuaacggagagacaggugaaauaguuugggacaagggccgagauuucgcuaccgugagaaaggugcugagcaugccucagguaaauaucgucaaaaagacagaggugcagacugggggauuuucuaaagaguccauucuucccaagcgcaacagugacaaacucaucgccaggaagaaagacugggauccaaagaaguacggcgguuucgacagccccaccguugcauacucugugcuggucguggcgaaaguugaaaaggggaaauccaagaaauugaagucagugaaggagcugguaggcauuacgaucauggaacguaguagcuuugagaaagauccugucgacuucuuagaggccaagggauauaaagaagugcggaaggaucucauaauuaaacugccaaaguacucgcuuuuugagcuggaaaauggcagaaagaggauguuggcuuccgccggggagcuccaaaaaggaaacgaacuggcacuaccgucuaaguaugugaauuuccuguaccuugcuagccauuaugagaaacucaagggcucacccgaggacaacgaacagaaacagcuguucgucgagcagcacaagcauuacuuggaugaaaucaucgagcaaauuagugaauuuuccaagcgcguuauauuagccgacgcaaaucuggauaaagugcucucugccuauaacaagcaccgagacaaaccuaucagagagcaggcugagaauauuauccaucuguucacccuuacaaaccugggugcgccagccgcauuuaagugcuucgauacuaccauugggcggaacagguacaaaagcaucaaggaaguauuggacgcuacacuaauacaccaguccaucacuggacuguacgagacccgcauugaucucucacaacugggcggugacuga

SEQ ID NO: 3114 - RNA, 4107 nt, Artificial Sequence
  Cas9 variant
auggacaagaaauacagcaucggccuggauauugggaccuccucuauaggauucgugggugucgacgagaacggcuggccccucaauaucaaggggaaaagagccauuggagcucaccuuuuuagggaaggcgaggcagccgcggaaacacgggguuuccgcacuacgcgacguagauauaacaggcggaaguggcgccugagauuguuaagggagaucuuugaugaaccuauuucacggguugacccaaccuucuuugcucgcaugaaagagaguagcguguccccgaaggaucccaauuacgacgggcuggccaaggagauccuaauaccucgagauaaagacggaaagauccucuauccaacaauuuaccaucugagacacgcacuuauguaugaagaucaucaguucgacaucagggagauuuaccuggccauccaccauauaguaaaauaucggggccacuuuuugcucgauggcgcugcaaagaacuucgaaucuucgaaucuggaccugaaaucagauauucacgagaucaacgccauucucguggggaucuuuggaaaugagcaaguccaguucaacgaccaguacguggaaaaguuaaaggagguucugcuugacagcacucagagucguuccgaucgccaaaaagcugccgcgaaguugcugcuacccaccaaugaccucgauaaagacacaaccaagauccugaaaacugugucuacagaaauuaccaaggcaauaacgggucuuaaagccaaguuuuucgucaucacuggcaacgauauugcuaaggaccagcagaaagauuggaccuuuagcaucgacacacuggaugagaagauguccgugauagaaccuucauucagugagaaaaauuucagcuugauuacuauccuccagaagcuguacucuuccguaaccuuagccgggaucguuccaaacggacugucacucagcgaggcaaugauucaaaaauaugacagacaugcuagugaucuugugcuguugaagaaguacugggacacaaaacccaagguccuaaaacaccagcugcagaauaccuaugccgaauacaucgagauucaucaggugguggacgaauuuuauucugaucucuccaagcugauuaaaaacgacgaugacacgcuugcgcaagagaucaagagcaagauuacuaucggcaauuuccugccuaaacagaggacaaccgaaaacggugucaucccauaccaguugcaacagcgggagcucgauacuauuauaaagaaccagcaggaguauuacccguggcuggccgaagagaaucccguugcagaccaccaaaucgcuuuuccuuacaaauuagaugaacuggugggguuccgaauaccauauuacguaggacccaugaucgccaaggaggacacaucgaacucuaaaaauuccaaguuugcuuggaugauucgcaagcagucaggcgaagugaccccuuggaacuucgaugagaaaaucgacagaacggccagugcaaccgccuuuauagauaggaugacaacuaccgacacauaucuaaucggcgaggauguccucccaaagcagagccugauuuaccagcgguucgaagugcuuaaugaguugaacaaaaucuccauugacgggcaacccaucacucgcaagcagaaacagucuguuuauacccacguguuugaaaagaaaaagacaguccaggugaaggacguacaaaaauuccugguuagcucaggagaggugaugagucucccgaagauagguggccuggcuaaugagaaacaguuuaacuccagccuuucuacccuguacgauuauaauaagauuaucccugacgcguuggaagauagaaacaaagucgacgauauugagaagaucauacucuggucaacuaucuucgaagacaauaguauuuuuguggagaagcuggauagcaucgacugguuaacguccucucagaggaaacgucuggcacagaagcgguaccgaggguggggaagacuaucgcucaggcugcuuacaaccuucaaaaacaaggauggcuacagcauuuuggacgaacuguggaacuccaaucauaauuucauggagauccaagcccagucagauuuuagugagcagauagcuacugccaacaacaauaaccucucucaaguccugcccgcaaaaugggaaccaggucgcaagaauuuagccagccuggacgaguucauuuccaaccuuuauaccucaccucagaauaagaaagcucuccggaaggccaucagagugguucaggauaugaugacagcagcggggcacaugcccgaaaagaucuuuauugagguggcuagggacaccagcaacucucaucagcaaacuaucgcccgccagcgacagcuccagcaacuguaccaguccgaagacaaggagguaauugauaguagcguccggucugagcuagacgauauacugaaaaaucgugcaaacaucaaggaccaguuguuccuguauuuucagcaaggcggaagagaucuuuacacaggcaaggccauuaauaucgacaaauugucccuguaucacauugaucauaucuuaccacagucacucgugaaggacgauagucuggacaacaggguucuugugagccagaaaacgaaugaagauaagggggucaccuucgugucggacaaauacaugaacaauaugcugcccacuuggaagcgcuggcacgagaugggauugauauccgcucggaaacucaagaaccugacaaugagaccugacgaaaucgauaaguaugccccagguuuuauucaaaggcagcuaguagagacccgacaggugacaaaacugguuaucgaacuccuggacgcacuuuugggcaauucucagacugagauuaucaccauaaaggcuagccugucacaccaauuccgccagcaguuugauuuagucaaaauucgggaggugaacgacaaccaucacgccuucgaugcguuucucgccgcuagaaucgggacguaccuguacaagagguauccgaaacuucgucccuacuucguguauggacaguacaugcaaaaucauaagaaccugaagaguaucaaucuaauuaaaacccucgacuccgauaaggcaauagucgacgaaggcacaggugagauccugugggauaaaaagucugacuuggccaaaaugauuaagaucuauaacuaccagcgccuguuaauuacucacgaaagccggaccuccuuuggggcuauguauaagcagaaaauccucaaggccacagaugcaaaacagaauggcggaggcuucaagcugguuccuacuaaaagaaacaggccaguggacauauacgggggauacaccggucaaacggcggccuaucuuacaaucgugcgaguauacucaaagaagaccagcgagcugcgggucuugcccauuuauacuaauaaagugcagcagaucgagaaggcuaugacacagggcgauaaagccaccaugcucgcauucaagaaaguuauugcuccucaacuggggaaggaaaacaagaaaacucacgagaucaagauaccagaauuugacguggucauucccaaagugcuacuggaccagcuuguuaucgaugacaucgccggaaguccgcaucgcuucagacucggcaccgauacauacuaucacaauucucagcaacuguuuuugccucuguccaugcagaggcaguuaauggaccgggagagcgaugacaagguguaccucgauauuuucaacgacguacugaaacaggucgauucguauuuuaaucuuuacgacgugaacgguuuccgagcagcccugcaaaagucuaaaaaggcuuuugaacaguugccaaucaaugauuuccccaaggacgugccugauaacaaaaagaaaaaggggaaaagaucaauacucaaggagauuuuuaucggccugcaugcgaaugccacgcuaggaaaccugaagcagaugggcauuaaaaccgacuucgggaaacuucagaaaaguaacggacuccgcaucacugagaauugcaagauaauucaccaaucccccacaggccuguuugaaaggaucgucccaaucaaauga

SEQ ID NO: 3115 - RNA, 4107 nt, Artificial Sequence
  Cas9 variant
auggacaagaaauacagcaucggccuggauauugggaccaacuccgugggaugggccgucauaacagacgauuauaagguucccucuaaaaaguucaaagugcucgguaauacugacagacacucaaucaagaagaaccuuauuggcgcucuguuguuugauaguggggagaucgcagaagccacgagguuaaaacggaccgcgcgccgacguuacacaagaaggaagaaucggauuugcuaucugcaggagaucuucagcaacgaaauggcuaaaguagacgauuccuuuuuccaucgccuagaggaaucuuuucucguggaggaggacaagaaacacgaaagacauccuauauucggaaauaucgucgaugagguggccuaccacgaaaaguauccaacuauuuaccaucugaggaagaaacuuguugacucgaccgauaaggcagaccugcgguugaucuaucucgcccuggcucacaugauuaaauuucgcggccacuuccugaucgagggugaucucaacccggacaauucagacguggauaaguuauuuauacaacugguccagacauacaaccagcuuuucgaggaaaaucccauuaacgcaagcgggguggacgccaaagcuaucuugagugcccgacuguccaagucuagaaggcuagagaaucucauugcgcagcugccuggagaaaagaagaacggccuuuuuggcaaucugaucgcauugagccucgggcugaccccaaacuucaaguccaauuuugauuuagccgaggacgcuaaacugcaacucucaaaggauacuuacgacgaugaccuugauaaccuguuggcccagaucggagaccaguaugcagaucuauuccuggcugccaaaaaccucagugacgcgauucugcuuagcgacauacugcggcucaauucugaaaucacaaaggcccccuuguccgcaucaaugauuaaacguuacgaugagcaucaccaggaccugaccuuacugaaggcucuaguacgccaacagcucccugagaaguauaaagaaaucuucuuugaucagagcaagaacgguuacgccggcuauauagacgggggagcuagucaggaggaauuuuacaaauuuauuaagccaauccuggagaaaauggauggcacggaggaacuuuuggccaagcugaauagagaggaccuccugaggaagcaacggacuuucgauaacgguucuaucccccaucagauucaccuuggggaacugcacgcaaucuugcgacgccaggaggacuuuuauccuuuccucaaagauaauagagaaaagauugagaaaauacugaccuuuaggaucccauacuacguuggaccguuagcccggggcaacucccgcuucgcuuggaugacaagaaagagcgaagagacuauuacccccuggaauuuugaggaaguggucgacaaaggcgcgucggcacaaucuuucaucgagaggaugacaaacuuugauaagaaucugccuaacgaaaaggugcuaccaaaacauucccuccuguaugaguacuucaccguguauaaugagcuuacgaaggucaaauacguuacugaagggaugcguaagcccgccuuuuugucaggagagcagaaaaaggcuaucguggaccuccuguucaaaacaaaccggaagguaaccgugaagcagcugaaagaagauuauuucaagaaaauugaguguuuugacagugucgaaauaagcgguguggaggaccgauucaaugccuccuuaggcacuuaccacgaucugcuuaagaucauuaaagacaaggauuucuuggacaacgaggaaaaugaggauauccucgaagacauuguucugacacuaacccuguucgaggauagagaaaugaucgaggagaggcucaagacguaugcacaucuguuugacgauaaagugaugaagcagcuuaaacgccggagauacaccgucugggggagguugucucgcaagcugauaaacggaauccgagacaaacaaagcggcaagacaauuuuagauuuccucaagucagacgguuuugccaaccggaauuucaugcagcugauccacgaugacagucuuacuuuuaaagaagacauucagaaggcucagguguccgggcaaggcgauagccugcaugagcacaucgccaacuuggcaggaucuccugcgauuaaaaagggcauacuccagaccguaaaaguuguggacgaacuggucaaggugauggggcgucacaagccagagaauaucgucauugaaauggcuagagagaaccagacaacucagaaaggacaaaagaacucaagggagcgcaugaaacggaucgaagaggguauaaaggaacuaggcagucagauccugaaagagcaucccguggagaauacccagcuccagaaugaaaagcuguaccuuuauuacuugcaaaacgggagagauauguauguugaccaggagcuggauauuaauagguuaagcgacuacgauguggaccacaucguaccgcaguccuucauuaaagaugacucuaucgauaacaagguccucacacgaucggacaagaaucgcggaaaaagcgacaacgugccuuccgaagagguugugaagaaaaugaagaauuauuggcggcaacugcuuaacgccaaacugauaacccagagaaaguuugauaaucuaacuaaggcagaaaggggcggucucucagagcuggacaaagccggguucauuaagcgucaguuggucgagacgcgccagaucacaaaacauguggcucaaauccuggauagucggaugaacaccaaguacgacgaaaacgauaaauuaauuagagagguaaaggugaucacucucaagucuaaacugguuagcgacuuuaggaaggauuuccaguucuauaaaguccgagaaauuaauaacuaccaccacgcccaugacgcauaccuuaaugcuguggugggcaccgcccugauaaagaaauaucccaaguuggaguccgaauuugucuacggagauuauaagguuuacgacgugcggaaaaugcucgcgaagucagagcaggagaucggcaaagccacagcuaaguauuucuuuuacagcaacauuaugaauuucuuuaaaaccgaaaucacucuggcaaacggggagauucgcaagagaccacuaaucgaaacaaauggagagacgggugaaauagugugggauaagggcagggacuucgccaccguacggaaaguccugucuaugccucaggugaacaucguuaagaaaacugaggugcaaacagggggauuuuccaaggagaguauucuucccaaacgaaauagcgauaagcucaucgcucgcaaaaaggacugggacccaaagaaauauggcgguuucgauucucccaccgucgccuacuccgugcugguuguggcaaagguagaaaaagggaagaguaaaaaguugaagucagucaaagagcuguuaggcauuacaaucauggaaagaagcucguuugagaagaacccuauagacuuccucgaggcgaaaggauacaaggaagugaggaaagaucugauuaucaaacuuccaaaguauucccuguuugaguuggaaaauggccguaaacggaugcucgccucugcuggggagcugcagaagggaaacgaacuagcccugccgagcaaauacgugaauuuccuuuaucucgcaucacacuacgagaagcugaaaggcagucccgaggacaacgaacagaagcaguuguucgucgagcaacauaagcacuauuuagaugaaaucauugagcagauauccgaauuuucuaaaagaguuauccuggcugacgccaaucucgauaaggugcugagcgcauacaacaaacauagggacaagccuauucgcgagcaggccgagaacaucauucaccuuuucacucugaccaauuugggugcuccaacggcguuuaaauauuucgauaccacaaucgaccgaaagagauacacuuccaccaaagaaguacuagaugccacauuuauacaccaaucaaucacugggcuguacgagacccggauugaccucagccagcugggaggcgauuga

SEQ ID NO: 3116 - RNA, 4107 nt, Artificial Sequence
  Cas9 variant
auggacaagaaauacagcaucggccuggauauugggaccaacuccgugggaugggccgucauaacagacgauuauaagguucccucuaaaaaguucaaagugcucgguaauacugacagacacucaaucaagaagaaccuuauuggcgcucuguuguuugauaguggggagacggcagaagccaccagguuaaaacggacagcgcgccgacguuacacuagaaggaagaaucggaucugcuaucugcaggagauuuucagcaacgaaauggcuaaaguagacgauuccuuuuuccaucgccuagaggaaucuuuucucguggaggaggacaagaaacacgaaagacauccuaucuucggaaauauagucgaugagguggccuaccacgaaaaguauccaaccaucuaccaucugaggaagaaacuuguugacucgacagauaaggcagaccugcgguugauuuaucucgcccuggcucacaugaucaaauuucgcggccacuuccugauugagggugaucucaacccggacaauucagacguggauaaguuauuuauccaacugguccagaccuacaaccagcuuuucgaggaaaaucccauaaacgcaagcgggguggacgccaaagcuauuuugagugcccgacuguccaagucuagaaggcuagagaaucucaucgcgcagcugccuggagaaaagaagaacggccuuuuuggcaaucugauugcauugagccucgggcugacuccaaacuucaaguccaauuuugauuuagccgaggacgcuaaacugcaacucucaaaggauacauacgacgaugaccuugauaaccuguuggcccagaucggagaccaguaugcagaucuauuccuggcugccaaaaaccucagugacgcgauccugcuuagcgacauucugcggcucaauucugaaauaaccaaggcccccuuguccgcaucaaugaucaaacguuacgaugagcaucaccaggaccugacguuacugaaggcucuaguacgccaacagcucccugagaaguauaaagaaauuuucuuugaucagagcaagaacgguuacgccggcuauaucgacgggggagcuagucaggaggaauuuuacaaauuuauaaagccaauucuggagaaaauggauggcacugaggaacuuuuggccaagcugaauagagaggaccuccugaggaagcaacggaccuucgauaacgguucuaucccccaucagauccaccuuggggaacugcacgcaauuuugcgacgccaggaggacuuuuauccuuuccucaaagauaauagagaaaagaucgagaaaauucugacauuuaggauaccauacuacguuggaccguuagcccggggcaacucccgcuucgcuuggaugacuagaaagagcgaagagaccaucacacccuggaauuuugaggaaguggucgacaaaggcgcgucggcacaaucuuucauugagaggaugaccaacuuugauaagaaucugccuaacgaaaaggugcuaccaaaacauucccuccuguaugaguacuucacgguguauaaugagcuuacuaaggucaaauacguuacagaagggaugcguaagcccgccuuuuugucaggagagcagaaaaaggcuaucguggaccuccuguucaaaaccaaccggaagguaacugugaagcagcugaaagaagauuauuucaagaaaaucgaguguuuugacagugucgaaauuagcgguguggaggaccgauucaaugccuccuuaggcacauaccacgaucugcuuaagauaaucaaagacaaggauuucuuggacaacgaggaaaaugaggauauucucgaagacaucguucugacccuaacgcuguucgaggauagagaaaugauugaggagaggcucaagaccuaugcacaucuguuugacgauaaagugaugaagcagcuuaaacgccggagauacacaggguggggaagguugucucgcaagcugaucaacggcauacgagacaaacaaagcgguaagacuaucuuagauuuccucaagucagacggguuugccaaccggaauuucaugcagcugauucacgaugacagucuuaccuuuaaagaagacauccagaaggcucaggucuccggccaaggagauagccugcaugagcacauugccaacuuggcaggcucuccugcgaucaaaaaggggauacuccagacagugaaaguaguugacgaacuggugaaggucaugggacgucacaagccagagaauauugugaucgaaauggcuagagagaaccagacuacccagaaaggucaaaagaacucaagggagcgcaugaaacggauugaagagggcaucaaggaacuagggagucagauacugaaagagcaucccgucgagaauacacagcuccagaaugaaaagcuguaccuuuauuacuugcaaaacggaagagauauguauguggaccaggagcuggauaucaauagguuaagcgacuacgauguugaccacauugugccgcaguccuucaucaaagaugacucuauugauaacaagguacucacccgaucggacaagaaucgcggcaaaagcaacaaugucccuuccgaagaggugguuaagaaaaugaagaacuauuggcggcaacugcuuaaugccaaacugaucacucagagaaaguuugacaaccuaacgaaggcagaaaggggugggcucucagagcuggauaaagccggcuucauaaagcgucaguugguggagacacgccagauuaccaaacaugucgcucaaauccuggacagucggaugaacacuaaguacgaugaaaaugacaaauuaaucagagaggugaagguaauuacccucaagucuaaacuggugagcgauuuuaggaaggacuuccaguucuauaaaguucgagaaaucaacaauuaccaccacgcccaugaugcauaccuuaacgcugucgugggaacagcccugauuaagaaauaucccaaguuggaguccgaauuuguguacggcgacuauaaggucuacgauguucggaaaaugauagcgaagucagagcaggagaucgggaaagccaccgcuaaguauuucuuuuacagcaauauuaugaacuucuuuaaaacugaaaucacacucgcaaauggagagauucgcaagagaccacugaucgaaacgaacggugagaccggcgaaauagugugggacaaggggagggauuucgccacugugcggaaaguacuaucuaugccucaggucaauaucgugaagaaaacagagguucaaaccggaggcuuuuccaaggagaguauucugcccaaacgaaacagcgacaaacuuaucgcucgcaaaaaggauugggacccaaagaaauaugguggguucgacucucccacaguggccuacuccguccucgugguugcaaagguggaaaaaggcaagaguaaaaagcugaagucaguaaaagaguugcugggaauuacuaucauggaaagaagcucguuugagaagaauccuauagauuucuuagaggcgaaaggcuacaaggaagucaggaaagaccucauugugaagcugccaaaguauucccuuuuugagcuggaaaacgggcguaaacggauguuggccucugcuggagagcuccagaagggcaaugaacuggcccuaccgagcaaauacgugaacuuccuguaucuugcaucacacuacgagaagcucaaagguagucccgaggauaaugaacagaagcagcuguucgucgagcaacauaagcacuauuuggacgaaaucaucgagcagauuuccgaauuuucuaaaagaguuauauuagcugaugccaaccuggacaaggugcucagcgcauacaacaaacauagggauaagccuauccgcgagcaggccgagaauauuauccaccuguucacccuuacgaaccugggggcuccagcggccuuuaaauauuucgacaccacaauugaucgaaagagauacacuuccaccaaagaaguauuggacgcaacauuuauccaccaaucaauaacuggacuauacgagacccggaucgaucugagccagcucggcggugacuga

SEQ ID NO: 3117 - RNA, 4107 nt, Artificial Sequence
  Cas9 variant
augagcagacccuacaacaucggccuggacauugggaccuccucuauaggauggucaguggucgaugaccagaguaagcucguuagcgugagggguaaauauggcuacgggguacggcuuuaugaugagggacaaacagcugcugaacgccgauccuuccguacuacgagaaggcggcugaagcgcagaaaauggagguugggcuuacugcgggagaucuuugaaccuuacauuaccccaaucgacgauacauucuuucuacgccagaagcagucuaaucucucgccgaaagaccagcgaaagcuguauacucaaaccucacuuuucaacgauagaacagacagggcauuuuacgaugacuaucccaccauuuaccaccuucgguaccguuugaugacugagaagcgccaguucgauaucagagaaauauaucucgccaugcaucacaucgugaaauacaggggucauuuucugaaugaggcgccugucagcaguuucaaguccucugagauuaaccugguggcucacuuugaccggcucaauacaaucuucgccgauuuauuuagcgaauccggguuccagcuggagaccgacaaacuugcagaaguuaaggccuugcugcuagacaaccagcaaucagcuaguaaucgacagcgccaggcacucagccugauuuauacgccaucuacuaacaaagccguggagaagcagaauaaggcuaucgccaccgagcuucugaaagcgauauugggacucaaggcaaaauuuaacguccugacaggcauugaagccgaggaugugaaggcuuggacuuuaaccuucaaugccgaaaacuucgacgaggaaaugguaaaacuggaguccucacucgaugacaaugcacaucaaaucauugagagccuucaggaacuguacaguggcguuuugcuagcugggaucgugcccgagaaccagucucugucccaagccaugaucacaaaguaugaugaccaccagaaacaccucaagaugcugaaggcggucagagaagcccuugcaccuggagauaggcagcggcugaaacaggcuuacgaccaauauguggauggucaggagaauaccaaggccuacagcaaagaagacuuuuacggcgauauuacgaaggcuuugaaaaacaacccagaccaucccauagugucggagaucaagaagcucauugagcuggaccaguucaugccuaaacagcgcacuaaggauaauggggccaucccacaccaauuacaucagcaggaacuggacagaauaauugagaaccagcaacaguauuacccguggcuagcagaacucaaucccaacucuaaaaggcagacagucgccaaguauaaacuggaugagcuuguugcuuuucgugugccuuacuauguaggaccauugaucaccgcggaacagcaacggcaguccucagacgcaaaguucgccuggcugauccgaaaggcugagggcagaauuacucccuggaauuuugaugacaaaguggauaggcaggccagugcaaacgaguucaucaagcgcaugacaaccacggacaccuaccuccuggccgaagauguccuuccuaaacaaagccugauuuaucagcgguuugagguguugaaugaacucaacggucugaagauagacgaucagccaaucacaacugaguuaaaacaggcuauuuucaccgaccuguuuaugcaaaagaucuccguuacagugaagaauauccaggauuaccuagucucugagaaaagauacgccagcaggcccgcaauuacugggcucucagacgaaaacaaguucaauagucgccuguccaccuaucacgaccuuaaaaugauagugggagaugcgguagacgauguugacaagcaggcugauuuggagaaaugcaucgaauggagcacaauuuuugaggacggcaagaucuacucugccaaacugaacgaaauugauuggcucaccgaccagcaacgagugcagcuggcagccaagcgguaucguggcugggggagauuaucagcuaagcugcuuacucagaucgucaaugccaacggacagaggauaauggauuugcucugggacacgacagauaauuucaugcgcaucgugcacagugaggacuuugauaaacugauuaccgaggcaaaccaaaugaugcuagcugaaaacgacguccaggacgugaucaaugaucuguacacuagcccgcagaacaagaaagcccuccggcaaauucugcuuguugugaaugacauccagaaggcgaugaaaggucaggccccugagagaauauugauugaguucgcuagggaggaugaaguaaacucccgacugucuguccagcgcaagcggcaaguggagcagguuuaucagaauaucucgaacgaguuacucaauaacaccgaaauuagaaaugagcugaaggaccuuagcaacuccgcacugucaaauacaagguuguuccucuacuuuaugcagggcgggcgugauauguauaccggagacagucugaacaucgaucgccuaucuacuuacgacauagaucauauccugccccagagcuucauuaaagacaauucccucgauaaccgggugcuggucucacaaaagaugaauagaagcaaagccgaccaggugccaacagacuuuacgucuguagaacuuggccagaagaugcaaauccagugggagcagauguugagggcuggucugauuaccaaaaagaaguacgauaacuuaacucucaacccugaccacaucuccaaauaugccaugaagggguucauaaaucgacagcugguggaaacacggcaaguuauuaaacuugcaaccaaccugcuaauggagcaguacggcgaggauaauaucgaacucaucacagucaagaguggacugacucaucagaugcgcaccgaguuugacuuccccaaaaacagaaauuugaacaaucaccaucacgcguuugaugccuaucugacggcuuucgugggcuuauaccuccugaagagguauccaaagcugaaacccuacuuuguguauggggaauaccaaaaggccagccagcaggacaaauggcggaacuucaauuuucugaacggauugaagaaagaugagcucgucgacgagaauaccgaagcaguuauuugggauaaggagucuggucuggcuuaccuaaacaaaaucuaucaguucaagaagauucuggugacacgaggcgugcacgaaaauuccggggcccuuuuuaaccaaacucucuacgcagccaaagacgauaaggcuucaggacagggcgguaaacagcugauaccugcgaagcaggacagaaguaccgccuuguaugggggcuacagcggaaaaacaguagcauauauguguaucguccgcauuaagaauaagaaaggcgaucuguacaaggugugcgggguugagacuucgugguuagcucaacucaaacagcugaccgacgaagacucccagaaggccuuccuugagcagaaaaucucuccacaauucacgaaggugaagaaacagaagggaaacauuaucgaggccgucgaagaguuugaagugauagcuccgcauauccugauuaaccagagguucuuugauaauggucaagaguugacacucggcagcgcaaccuauaaacacaacgaacaggagcugauccuagacaagacugccguuaaacugcuuaauggggcgcucccccugacacagucagaggaauuggcugaacagguguacgaugaaauuuuagaccaaguaaugcauuacuucccucuguaugauaccaaccaguuucgugccaagcucaguacuggaaaggcagccuucaugaaacugccauggaagucccagugggacggcaauaaaaugguccaggugggucaacaggugauccuugaucggauacugauuggguugcacgcuaacgcagccaugucugaccuaaagguccugaaaaugaccacacccuuuggcaugauccagcagagcacgggaaucacccucuccgcggauacucaaauuauauaccagucaccuacaggccuguucgagagaaggguugcccuucgcgacuuauga

SEQ ID NO: 3118 - RNA, 4107 nt, Artificial Sequence
  Cas9 variant
auggacaagaaauacagcaucggccuggauauugggaccaacuccgugggaugggccgucauaacagacgauuauaagguucccucuaaaaaguucaaagugcucgguaauacugacagacacucaaucaagaagaaccuuauuggcgcucuguuguuugauaguggggagacggcagaagccaccagguuaaaacggacagcgcgccgacguuacacuagaaggaagaaucggaucugcuaucugcaggagauuuucagcaacgaaauggcuaaaguagacgauuccuuuuuccaucgccuagaggaaucuuuucucguggaggaggacaagaaacacgaaagacauccuaucuucggaaauauagucgaugagguggccuaccacgaaaaguauccaaccaucuaccaucugaggaagaaacuuguugacucgacagauaaggcagaccugcgguugauuuaucucgcccuggcucacaugaucaaauuucgcggccacuuccugauugagggugaucucaacccggacaauucagacguggauaaguuauuuauccaacugguccagaccuacaaccagcuuuucgaggaaaaucccauaaacgcaagcgggguggacgccaaagcuauuuugagugcccgacuguccaagucuagaaggcuagagaaucucaucgcgcagcugccuggagaaaagaagaacggccuuuuuggcaaucugauugcauugagccucgggcugacuccaaacuucaaguccaauuuugauuuagccgaggacgcuaaacugcaacucucaaaggauacauacgacgaugaccuugauaaccuguuggcccagaucggagaccaguaugcagaucuauuccuggcugccaaaaaccucagugacgcgauccugcuuagcgacauucugcggcucaauucugaaauaaccaaggcccccuuguccgcaucaaugaucaaacguuacgaugagcaucaccaggaccugacguuacugaaggcucuaguacgccaacagcucccugagaaguauaaagaaauuuucuuugaucagagcaagaacgguuacgccggcuauaucgacgggggagcuagucaggaggaauuuuacaaauuuauaaagccaauucuggagaaaauggauggcacugaggaacuuuuggccaagcugaauagagaggaccuccugaggaagcaacggaccuucgauaacgguucuaucccccaucagauccaccuuggggaacugcacgcaauuuugcgacgccaggaggacuuuuauccuuuccucaaagauaauagagaaaagaucgagaaaauucugacauuuaggauaccauacuacguuggaccguuagcccggggcaacucccgcuucgcuuggaugacuagaaagagcgaagagaccaucacacccuggaauuuugaggaaguggucgacaaaggcgcgucggcacaaucuuucauugagaggaugaccaacuuugauaagaaucugccuaacgaaaaggugcuaccaaaacauucccuccuguaugaguacuucacgguguauaaugagcuuacuaaggucaaauacguuacagaagggaugcguaagcccgccuuuuugucaggagagcagaaaaaggcuaucguggaccuccuguucaaaaccaaccggaagguaacugugaagcagcugaaagaagauuauuucaagaaaaucgaguguuuugacagugucgaaauuagcgguguggaggaccgauucaaugccuccuuaggcacauaccacgaucugcuuaagauaaucaaagacaaggauuucuuggacaacgaggaaaaugaggauauucucgaagacaucguucugacccuaacgcuguucgaggauagagaaaugauugaggagaggcucaagaccuaugcacaucuguuugacgauaaagugaugaagcagcuuaaacgccggagauacacaggguggggaagguugucucgcaagcugaucaacggcauacgagacaaacaaagcgguaagacuaucuuagauuuccucaagucagacggguuugccaaccggaauuucaugcagcugauucacgaugacagucuuaccuuuaaagaagacauccagaaggcucaggucuccggccaaggagauagccugcaugagcacauugccaacuuggcaggcucuccugcgaucaaaaaggggauacuccagacagugaaaguaguugacgaacuggugaaggucaugggacgucacaagccagagaauauugugaucgaaauggcuagagagaaccagacuacccagaaaggucaaaagaacucaagggagcgcaugaaacggauugaagagggcaucaaggaacuagggagucagauacugaaagagcaucccgucgagaauacacagcuccagaaugaaaagcuguaccuuuauuacuugcaaaacggaagagauauguauguggaccaggagcuggauaucaauagguuaagcgacuacgauguugaccacauugugccgcaguccuucaucaaagaugacucuauugauaacaagguacucacccgaucggacaagaaucgcggcaaaagcgacaacgucccuuccgaagaggugguuaagaaaaugaagaauuauuggcggcaacugcuuaacgccaaacugaucacucagagaaaguuugauaaucuaacgaaggcagaaaggggugggcucucagagcuggacaaagccggcuucauaaagcgucaguugguggagacacgccagauuaccaaacaugucgcucaaauccuggauagucggaugaacacuaaguacgacgaaaacgauaaauuaaucagagaggugaagguaauuacccucaagucuaaacuggugagcgacuuuaggaaggauuuccaguucuauaaaguucgagaaaucaauaacuaccaccacgcccaugacgcauaccuuaaugcugucgugggaacagcccugauuaagaaauaucccaaguuggaguccgaauuuguguacggcgauuauaaggucuacgacguucggaaaaugauagcgaagucagagcaggagaucgggaaagccaccgcuaaguauuucuuuuacagcaacauuaugaauuucuuuaaaacugaaaucacacucgcaaacggagagauucgcaagagaccacugaucgaaacgaauggugagaccggcgaaauagugugggauaaggggagggacuucgccacugugcggaaaguacuaucuaugccucaggucaacaucgugaagaaaacagagguucaaaccggaggcuuuuccaaggagaguauucugcccaaacgaaauagcgauaaacuuaucgcuagaaagaaggacugggacccaaagaaauaugguggguucgauucucccacaguggccuacuccguccucgugguugcaaagguggaaaaaggcaagaguaaaaagcugaagucaguaaaagaguugcugggauuaacuauuauggaacgcagcucguuugagaagaacccuaucgacuuccucgaggcgaaaggcuacaaggaagucaaaaaggaucugauaauuaaacuuccaaaauauucccuguuugaguuggaaaaugggaggaagcguaugcucgccucugcuggagagcugcagaaaggcaacgaacuagcccugccgagcaaguacgugaauuuccuuuaucucgcaucacacuacgagaaacugaaggguagucccgaggacaacgaacagaagcaguuguucguggagcaacauaaacacuauuuagaugaaaucaucgagcagauuuccgaauuuucuaagcgggucauacuggcugacgccaaucucgauaaaguucugagcgcauacaacaagcauagagacaaaccuaucagggagcaggccgagaacauuauccaccuuuucacccugacgaauuugggggcuccagcggccuuuaaguauuucgauaccacaauugaccgcaaacgauacacuuccaccaaggaagugcuagaugcaacacugauccaccaaucaauaacuggacucuacgagaccagaaucgaccugagccagcuuggcggugauuga

SEQ ID NO: 3119 - RNA, 4110 nt, Artificial Sequence
  Cas9 variant
augaagagaauccugggccucgaccuugggaccaacagcauuggaugggcccuggugaaugaggcugaaacagucaacgagaaauccucuauaguuaaguugggugugaggguaaaucccuuaacuguggaugaacagaaaaacuucgaggcaggcaagucaaucccuacgaaugccgggcggacccugaaacgcggaaugcgacguaaccuacaaagauacaagcucaggcgggacuaucugauucagugccuuaaggaauacggcuggaucacaagugauacucuguuguaugagugugguaaucgcaccacauuugagaccuacagacucagggcgaaagcugucgacgaagagauugcccuggaggaacuggggcgggugcucuuaaugaucaacaagaaacgcggauauaagagcaaucgaaaagcaaaguccucugaugagggccagcugauagacggcauggccaucgcuauggauauguaccacaacgggacuacaccaggagaauauguuuacucgcuuuugucaaaggguaaaaaguacauuccgguguucuauagaagcgaccugcuagaugaguuugacaggaucugggauuaccagugcgcauauuaccccgacauucucaccagucaauucaaagaacugauccggggcaaguccucucaggucacgagcaaacuuuuuaagcagcaguauaaucuguucacugccgauaacaaagagaaggacaagcguuugcaggcuuacugucgcagagccgacgcgcucaaaaagaggcugccuguggaagagguagcagccgcuuuaugcgauguuaaucgggacgugaacgccuccucaggguaucugggaaccauaagugaucgaagcaaaaagcucuuuuucaauaaacaaacagucggccaguaccuuaugcuggaguuggacaaggauucucauuuuuccgugaagaacgaaguguucuaccgccaggacuaucuaaacgaguuugaagcaauuugggagaaacaagcugaauaccacccagagcugacucccgauagaaagaaaauccucagggacgucguuauuuucuaucagcggccucugaagucacagaaagaucuuguggccuguugcgagcuggaacgcagaaggaucgagguaaugaaggacgguaaggugcguagcgucgaaaucgggccaaaagugugucccaagaguucuccuuuguuucaagauuucaaaauuuggcauguucucaauaaccugaaggugcgggacaaagcgaccggagacgagcgauucuuagaacuggaugagaaggagauacuauuuuccgaacucgccaucaagagcaaacugucgaagacagaggcacuuaaauugcuguaccagaagccaaaaggccucgaccugaauuaugauucugucgaaggcaacaccacgcaggcugcccuuuucgaggcuuaccagacugugauugccaugacagggcacggagaguauguauuuuccaagaugucagcaagugaaguuaugagcguggucgaggguguguucggcgggcugggauuuaauaccuccgucuugagauucgacucucuccugcaaggcaaagaauuagagaagcaggauagcuacaggcuguggcaucuacucuacucauaugaaggugacaacagugugacugggacagauggccugguugccaagguggcuucccuuuugcgcugcgacgaggaguacgcgaaaguagucgcaggagugaccuuucagccggauuauggcagccugucugccaaggcuauccggagaauacucccccacaugagggccgggaaugaauacucacuggcaugugaguaugccggauacaaacacagucgcaggagcuuaacgaaggaggaacuggaacagaaagacuauaaggaucaucuugaguugcucccucggaacucccugcguaauccaguuguggagaagauucuaaaccaaauggucaaugugguaaacgcugugguugacgccuacgguaaacccgaugaaaucagaaucgagauggcaagggaacugaagaaaucugcgaaggagcgcgaagagaugaccgcugccauuaauaaagcaacaucggagcacgaacggaucaaggagauucucaacaaggaauuuggcauacagcaugucagccacaaugacaucgugagauacaaacuguauugcgagcuuaagaacaacggguacaaaacuuuguauuccgacaccuacauuccucaggagaagcuguuuucaaaagaaguggauaucgagcacaucuuaccacaggcccgacucuucgacgauaguuuuucuaauaagacacuggaauaucgaagcgucaacauugagaaguccaaucaaacugcuugggacuacguugccgcaaaauggggagaagagggcucacuucgcuauaagaaacggguggaugaccuguuggcugccggugugauaggcaagagcaaacaugauaagcuccugaugaaacaggaggacauccccaccgauuucauuaacagagaccuaagggauacacaguacaucgcgcguaaggcccgcgaaauucuggaggaccucguaccgauggucgugucuaccacuggggcuguuacggaucggcugagagaagacuggcagcuuguggacgucaugcaagaguugaauugggauaaguacgcaaugaaaggacugacagaagaguggaccgacaaggauggcaggcgaaucucccggauaaaagaguggacuaagcgcaacgaccacagacaucacgccauggaugcuuuaaccaucgccuuuacaaaacauaguuucauucaguaucucaauaaccugaaugcaaggagcgacaagucuggguccaucuacgcgauugaacagaaggagcuuuaucgggauaaccacggaaaacugcgauucaucaugccuuuugaagguuucagaucagaggccaagcgccaacuagaaaauauacucgugaguauuaaagcuaagaacaaaguugugaccaggaauguaaacaaugcccgucggggcagcgggagacaggcaaagguccagcugacucccaggggacaguugcacaacgagacaaucuacggcucgauucaucgcuaugugacgaagcuggagaaagugggugggaacuuugacggcgaacaaaucgcuaaggucgccaauuuacgauacagagaggcacuccaggcccggcacgaggcuuucggaggcgaugcgaaaaaggccuuuaccgggaaaaacgcacuggacaagaauccacuuuaucugaaggauacuaggacagaaguuccuuugaaagugaagaccguauccacagagacucucuacaccauacgcaaagcuguggcccccgaccugaacgucgacaaggugaucgaugccaaaguucguaaggugcuagaagagagacugcaggaauacggaggcgacccaaagaaggcuuucgucaaucuugaugagaaccccauuuaucucaauaaagcaaaagguaucacgauuaagcggguggccaucaccgggguuaacaaugcgauagcucugcaugacaaaaaggaugugggaggccacgucauguuggacgccucugguaggaaacagccuguagauuuugugaacacaggcaauaaccaccauguugcaauuuaccgcgacgccgaagggagccugcaagagguggucgugucauucuaugaggcuguagcacgagugaguuuaggacucccagucaucgauagagaauaccggaaggaggacggcuggcaguuucuguucacuaugaagcagaaugaauauuuuguuuucccgaaccccgagaccggguuuaauccucaggaaguggaucuuacagacgagacuaacuacgcccugaucuccccaaacuuguucagggugcaaaaauucaccauuaaggauuauuucuuccgccaccaucucgagacgacagucgaagacagaaaagagcugaaggacaugaccuggaaaagguguggacuaggcgguaucauugggauagugaagguucggguaaaucacaucggacguauugugucugucggcgaauacuga

SEQ ID NO: 3120 - RNA, 4110 nt, Artificial Sequence
  Cas9 variant
auggccaagaccuacaacaucggccuggacauugggacaaauagcauaggaugggcuguggucgaugaccagaaccaccucauguccaucaaagguaaguauggcuacgggguuagacuuuaugaugagggaaaaacugcagaagagaggcggucuuuccgcacgacccgacguagacugaagaggcggaaauggcgcuugucauuacugagagaaauuuuugagccccaaaucacaccucuagacaauacuuucuuucucaggcagaagcagaguagccuguccucuaaggauaaccggaaacuuuacccagaaaugucgcuguucaaugaccgcaccgauacagacuuuuauacccaguacccgacuauuuaucauuugucacgagaucucaugacaaagaacaaacaauucgacaucagagagauauaccuggccauguaccacaucgugaaguauaggggccauuuucugaaugagagccccguaaguuccuucaaaucuagcgaaauuaagcucgcggagaacuuugaaaccuuaaaucagaucuucaacgagcgguuuaaugaguccauguuccagcuggcugugaacgauuuugacgaucuuaaggccuugcugcuaaaugaccagcaaucagcaaguaaccgucagaaaaaggcccucgguaugauuuacgucccuaaugaaaacaaaagccuggagaagcagaacaaagcuaucgcaacggaacuucugaaggccauauuggggcucaaagcuaaguucaaugugcugacuggaauugagguugacgaugccaagccauggaccuuaucuuucaacuccgaaucauuugacgaggauaucgacaaagcggcaacaaauauugaugacgauagccgcgagaucaucgccauucugcagggccucuauaguggcauacuucuggcugggaucauucccgaaaaccaaucuuuguccgaggccaugguggaaaaguacgaccagcacgcagcucaucuaaaacagcuuaagagcaucuauccucuccugucgauaucugauaaaaaggccauucaacaggcguacaauuauuacaucgacggacaggauaacgccaaggcauacuccagagaggacuucuaugcugccacuaccaaagcucuuaagucauaccaggacaaugaaacaaucgccgagauucugaaauugaucgagcucgaacaauuuaugccaaagcagaggaccaaagauaacggugcaauuccccaccagcugcaccagcaagaguuagaacggauaaucgagaaucagcagaaguauuacccuuggcuggccgaacuaaacccaaaugagagucgacgcaagauugcuaaauauaagcucgacgagcuggucgcguucagagugccguacuauguaggcccccuuaucacgagcgaacagcaacagcaguccucuaacaaaaaguuugcauggaugaucaggaaagccgaggggaagauuacuccuuggaauuucgaugaaaagguugaccggcaggcuagcgccaacgaguuuauaaaacgcaugacaaccacugauacauacuugcuggcagaggacgugcucccaaagcaaucacuggucuaccagagauucgaagugcuuaaugagcugaacggaaucaaaauugaugacgugcccaucaccgucgaacagaagcaaaggauuuuuaacgauuuguucaugaugcaggccaguguuuccgugaaaaauauccaggacuaucucguaagcaagggcuacuuugcuucucguccugagauaacgggucugucagaugaaaacaaagugaucagucgguuaagcaccuaucaugaccugaaggccauucuagggggaaucgucgaugaggcaaauaagcaggcggaccucgagaaaugcguggaaugguccacaauuuucgaggacggcaagaucuuuguugaaaaacugaacgagauagaauggcuuacugaugagcaacgaaagagauugucuucgaaaagguaccgcggcugggggcggcugagcaauaagcuccugaaccagauugugaaugagaacggacagagaaucauggacuuacugugggauaccacagacaauuucaugaggauuguccacuccgaagaguucgauaaacuuaucucagcugccaaccagacuuugcucaguaagaaugacgugcaagauguaauaaacgaccuguauaccucuccacagaauaagaaagcacuacgccagauccugcucguugugagcgauauucagaaggccaugaaaaaccaagcucccuccaagauccugauugaauuugcccgagaggacgaagcaaauccgcggcuuucaguccagcguaagagacagguggagcaagucuaccagaacaucagcaaagauauauugucugacuccgaugugaaggcugagcugaaagacuuaacaaacaccgcccucgcgaauacuaggcuguuccuuuauuuuaugcaggguggccaugacauguacacgggggaaacacugaacauugaucgcuugagugaguacgacaucgaucacauccucccucaggccuucauuaaggacaauagccuggauaaccggguucuagugucugcuaaaaugaauagauccaagucagaccaaguaccccugaacgauuauaccgaagagagguuuggaaguaagaugcgaguccagugggagcagaugcuccgcgcaggccugaucacuaaacggaaguacgacaaucuuaccuugaacccagauagaauuagcaaauaugccaugaaggguuucauaaauaggcagcugguggaaacacgucaaguuaucaaauuagugaccaaccuccugauggaccacuacgaggaugacgaaguccagcuuauuacugugaagucggggcugauccaucagaugcgcgagauguuugacuucccuaaaaaucggaaccuaaauaaccaccaucacgcuuuugaugccuaucucacagcauucguaggcauuuaccuguugaagagauaucccaagcugacgccauuuuucguguacggauccuaccagaaaaauaacaccaacgacaaguggaggaauuuuaacuucuuaaaugaucucaaaaaggaagagguuaucgacucugauagccaugaggucauauggaacaaagcgcaaggccugguggaacuugacaagaucuaucaguucaagaaaauucuggugacucgagagguccacgaaaauacaggggccuuguacaaccagacccucuauucagcuaaggaugacaaagccaguggacaggguggcaagcaacugauccccgcaaaacaggaucggccuacagcucuauacgggggauauuccggcaagacuguugccuacauguguauugugcgcaucaagucuaaaaaggaggacaccuauaaagugugcgguguaaagacgagcugggucgcagaacuggagagacuuuccgauucaaaugagcagcucgccagccugaaagcuaaguugaugccaaaguuuaccaaaaacaagaaacaaaaggggaaaacaauacaggugacugaagacuucgagauuaucguuccgagggugcugaucaaucagcgguuuuacgauaacggccaggaaauuaccuuaggaagugcgacauacaagcacaaugagcaagaacucaugcugaacaagaaagccgucaagcugcugaauggccaguugucucucguggaggcagagacucuggcuccccagguuuaugacgaaauacuaaaacaggugaugaaguacuucccucuguaugacaccaaccaauuucgaacgaaacuuaagauggggaaagagcaguucaucaagcucccauggaagaauaaaugggauggaaacaagcugauucauguaggucagcagacagucuuggacagaaucuuaauuggccugcacgccaaugccgcuguguccgaucucagcacccugaaagugacuacacccuuugggaaacuucaacagccuucgggaaucgcacugucauugaacaccaagauaaucuaccagucuccaacuggccuauucgaacgcagggucgcccugcguggucucuga

SEQ ID NO: 3121 - RNA, 4110 nt, Artificial Sequence
  Cas9 variant
auggacaagcccuacaacaucggccuggauauugggagccacuccauaggauggaccguggucgacgauaauucuaaacucguuagaaucaaggguaaacuuggcuauggggugaggcuguucgacgagggaaagacagccgaagaacggcgccaguuucgaacuacgcguagaagguugaaacggcgcaaguggagauuaaggcugcuacgggaaauuuucgagccucauaucgcuccacucgaugaaaccuuuuuccugcgccaaaagcagucaaaccuuguaccgacacagaaaaagcugccccaguugagucucuuuaaugaccgaagcgaugcagaguucuaccacaaauauccuacuauuuaccaucugagaaacgcccugaugaccgagaagaggcaauuugaccuccgggaaaucuauuuagcgauacaccauaucgugaaauaccguggccacuuccugaaugcugccccagcagccuccuuuaagucugguaaguucgaucuugagaacaaauuugaccaguugaaucugcuauucgcuucggcauauucagaucucgacuuuacacugcgcaccgauaacgucgaccaggugaaggccauucuucugaaugaagacuugagcgcuaguacuagacagaggcaagcccucccccugaucuaccagacauccgcggaucagaaagcagccaagaaauuaaccaagucucuggcuacggagcuccuuaaagccauucugggguugaaggcaaaguucgacguucuaacuggaaucgagaccgaugacacaaaggcuuggcggcugacuuucaacgccgaagauuuugacgauaagcucaaugagcugaacgugaccgacaaugaagcggccacacagauaauugagauccuucgagaacuguacagcuccauuuugcucgcagcuaucgucccugagaacuauacccugucacaagccaugauggcuaaauacaaugcccacaagcagcauuuaagucugcuacgccaggugaaaacgacucucccagcaaagaagcaaaaagagcugcaggccgcuuaugaugacuacaucgaucagcaccuucccuuggacaaguucuaugcgaaacugacaaagguacucccuaaagaaaaggacaccgauaacccacagauuauacaaauccugaaccuuauugaccuggaucaguuuuugccgaagcagagaacuaaagacaauggcgcaaucccccaucagcuccaccaacaggagcuggaucagauaauugacaaccagaaggccuacuauccuugguuagcucaacugaauccaaacgaaaagaggcagaagaucgccaaauacaagcuagaugagcucguugcauuccgggugcccuacuaugucggcccucugaucgaagccaagacacagcagaaaaccagcggggcuaauuuugccuggaugauucgcaaggagccaggaacgaccacacccaucacuccguggaacuucgacgagaaagugaauagacaagcaucugcgaacgaauuuauuaagaggaugaccacaacugauaccuaccuuuugggugaggacgugcugccuaaacacucccuccuguaucagcguuucgaagucuuaaaugagcugaacggcauaaagaucgaucagaaacggguuacagugcgacaaaagcaggcuauuuuuaaugaccuuuucuugaagcagcccaacguaaccgugaaaaagcuccagcaauaccugcaggccaaaggggaauaugcaucagccccaaucaucacuggacuaagcgauccuaagaaauuuaauagucagcugucuacguaccaugaguauaagaagauuuucggcggucucauagacgaccccgauaaacaggcugacuuugagaagugcaucgaaugguccacaauuuucgaggauagccaaauccugaaagacaaacuuaaagaaauuaacugguugaccccagagcagagacacaaggucgccaauaagagguaccagggguggggacgccugucgaaaaaguuacucacucagcugguggauuacaacggccaacggaucauagacauccuuuggaacaccacagauaauuucaugcagauuguucauucugaggcauuugacaaagcuaucauuaaggaaaaccaggcccuguugacccaauauaauccccaggcggugaucgaugaccucuacacuuccccucagaacaaaaaggcccugagacagauacuacuggucgugaaugauauucaaaaggcucucaaaggccaggcaccaucaaggauccugauugaguucgcccgcgaagggcaggagaacccgcgacuuaguacacagcggaagcaacagguagaaaaugcuuauaaagaggccagcgacgcauugcuguccucugcggagguucgucaggaauuaaagggacucgauaacaaagcccuggcuaauacgagacuuuuucuguacuucaugcaggguggcagggacaucuauaccgggaaaagccuaaacauagacgaucucucaaaauacgacaucgaucacauucugccccaagccuuuaucaaggacaauaguuuggauaaccgcgugcuggucuccgcaaagaugaaucggagcaaaucugaccaggugccuuuaaacgauuucgcugagauuagauauggaaagcagaugaggcagcaaugggagaaaaugcuccgagccggccugaucacucgcaagaaauaccauaaucuuacacugaacccagagucaauaaacaaguacaccgcaaaggguuuuauuaaucggcaguuggucgaaacaagacaggugacuaaacucgccaccaaccugcuaguugaccaauaugcugaggaugacgugcagcugaucacgguaaagaguaaucuuacccaccagaugagggaggaguucgauuuucccaaaaaccguaaugucaacaaucaccaucacgcguucgacgccuaccucacagcauuuguggggcuguauuugcugaagcgcuacccuaaauuagcuccauauuucguuuacggcgacuaucagaagggagccagccaaaacuccaaguggcggaauuuuaacuuccucggcaaucugcauagagaaaaaguggucgauaagaacacuggggaaaucauuuggcagagggacgccggacuuggugagcugaaucgaaucuacaacuucaaaaagauuuuggugacccgggcucuccgcguaaauagaggccccauguuuaaacagacaauauacaaggcagaagaggauaagucuucggggaggggaagcaaacagcugaucccgacuaagaaaaaccggccuaccgagcuauauggcgguuacacgaacaaggaaacagccuaucugugucuugugaaagagccacacaagaagggggacauuuaccgaaucugcuccguucucaauauguggcugaccgaauuggauagaauugcggaccccaucgcuaaagcccaaaaguuaacugagcugcucacaccucaguucaccacuaccaaaaagaaacagggccagaagauacccgucgugaaaccauuuaagguggucaucccuaagauucugaucaaccaacgcuucuuuucaaggggacaggagcuuacaguugcaagucccauguauaugcacaaugaacaggagcuguucuugaacaaaaagacgauuaaacuacugaauggccaacucgccaagaacgaagcucaugagcuggcaccaaaaaucuaccagcagauacuugaucaggugaaugacuauuuuccguuauacgauauguacaaguuccgugacacccugaacgccucuaaggaaauuuuugugaaucucccuuggcaagaucagcggcaggacaaaaagaucagccaguccgggcaaaaaucaaucuugaacaagauucugauaggacuccacgcgaaugcugccagaaucaaacugacugagcuuaacuucaagagcgauuuuggucuguugucucagagguccggcauugcauucagucccgacgaccagaucauuuaucagagcccaacagggcuauucgagcgccgaguaacccugaaggaucucuga

SEQ ID NO: 3122 - RNA, 4110 nt, Artificial Sequence
  Cas9 variant
augaaggugaacaauuaccacaucggccuggacauugggaccagcuccauaggaugggucgccaugggugaggauggcaaaccccucagaguuaaggggaaaacagcuaucggagcaaggcuuuuccgggaaggcaacccugccgcggaccgccgaauguuucguacuacgagaaggcggcugaaucgcagaaaguggagguugaaauuacuggaugagauuuucgacccauauaucaccccgguggauucuacauuuuucgcucggcuaaagcagucaaacuggagucccaaggacagccgcaaagccuuuaaggauuccacucucuucccugaccugaccgauaaacaauaccaucuugacuauccaacaauuuaccacuuacgacaugcauugaugacccaggauaagcaguuugacaucagaaugguauaucucgcccugcaccauauagugaaauacagggguaauuuccugaacucuacucccgucgauucguuuaaggcuucaaaggugaauuucgacgaccaguuuaaaaagcucaacgaauuauauacagcaaucaauccugaggaaucauuccaaauuaacuuugccaauagugagaaaaucgggcagcaguuccuggauccauccauucggaaguucgacaaaaagaaacagaucucuaagauaguucccgugaccauggaugacaaggcugucgauaaacuuaacggaaagauugccagcgagaucgugaaugcgauuuugggcuacaaauccaagcuggacguagcaguucaaugcgauccugaagacucaaaaccaugggccgugaaguuugaugacgaggauaucgacgcuaagcuacagaaaauccucccggaaauggacgagaaccagcagaguauuauaggcaucauucaagaucuguacagccaggucacgcuuaaucagaucgugcccaacgggaugucucuguccgagucaaugauaaagaaauauaacgaccaccacgaucauuugaagcucuacaaaaagcugauuggacaaaucagcgacaguaagaaaaagacugcccugaaaaaggcauaugaucaguacguggguaaugacggcaaagucaucgaacaggaugacuucuauucuuccguuaagaagaaccuggaugacagcgagcucucgaaacagauuauggaucuuaucgacgcugauaaguuuaugccuaaacaacguaccucucagaauggggugauuccacaccagcugcaucagcgcgaauuggacgagauaaucgaacaccaauccaaguacuaucccuggcuagccgagucaaacccuaauaaacacgaccugcaucucgcgaaguacaaaauugaggaacugguagccuucagaaucccauacuaugugggacccaugaucacaccggaggaucagaagaagaguggcgcagcugucuuuagcuggaugaaaaggaaggaaccuggucagauuacucccuggaacuucgaccagaaaguggaucggauggaguccgccaauaaguuuauaaaacgaaugaccacaaaggacaccuaccuuaucggggaagauguucugccagacgagucuuugcucuaugagaaguucaaagugcugaacgaauuaaauaugguccgcgugaacggagauagccugaagguagcugacaaacaagccauuuaccaggaucuauuugagaauuauaagcacaucucaguuaaaaagaugcagaacuacauuaaggacaaaacgggccucccuaauaaccccgauaucaguggccuguccgacccagaucauuucaauaacagccuugggacuuauaacgacuuuaagaaauuguucggagacaagguggaugaccccgaucugcaggacgauuuugaaaagauagucgaguggucuacaguguucgaagacaagaagauccucagagcaaaacugaaugagauuucauggcuuagugauaagcaaaaagacgaucuggagagcuccagguaccagcgguggggucgcuugucuaagaaacuccugaccggcaucgucaacgaccagggggaaagaauuaucgaugaguuauggaauacuaacaagaauuucaugcaaauacagucggacgacgauuuugccaaaaggauucacgaagcuaacgcggaccagaugaaggcaacagauguggaggacguucuggccgaugcuuacaccagcccucagaauaagaaagccauccgucaagugguaaaggucguggacgauauucagcgggcaaugggaggcguugccccaaaauucaucuccauagaguuuacgcgaucagaagacagaaacccgaggcgcaccaucagucgggagagacagcuagaagauacacucaaggacacugcuaaaacccuggugaagucuaugaaucccgauauucuuagcgaguuggacaacgccuccaagagcaaaaagggucugacagauaggcucuaucuguacuucacucaguuagggcgcgacauguauaccggcaaaccuaucaauauugacgaaaucagcaacuacgauauagaccauauucugccacaagcauuuaucaaggaugacucucuuuccaaucgagucuuggugaguaaagcgguaaacaauggaaagagcgcuaacgugccccucaagcuguucggcguuaaaauggcccacuuuuggaagcagcuagcagaggccgggcugaucaacaaacggaagcucaaaaaucugcagacaaacccugauaccauuucuaaguucgcuaugcacggauuuauccguagacagcuugucgagacuucccaagugauuaaguugguggccaauauacugggugacaaauauaggaacgaugacacgaagaucauugaaaucacagcacgcaugaaucaucagaugcgggaugaguucgcuuuuauuaaaaacagagaaaucaaugacuaccaccaugccuucgaugcguauuuaaccgccuuucucggcagguaccuguaccaccgauauauaaaacuucgcccauacuucgucuauggggacuucaaaaaguuucgggaggauaagguuacuaugagaaacuucaauuuucugcacgacuugaccgacgauacacaggcuaggaucgcagacaccgaaacuggagaggugauuugggaucgugagacaucaaucaaacaacuccgcgacguguaccauuauaaguucaugcugauuagucaggaaguauacacgcuacggggcgccauguuuaaccagaccaucuaucccgcugaugaggccgguagaaagaagcugauaccgacuaaagcagacaaggcggucgauguguacgggggcuacagcggaucgaaugacgccuauauggcuauuguuaggauccacgauaaaaagggcgacaaguacaaaguggucggggugccuaugcgagcccucgaucggcugaacgcagcuaagaauguuuccgacgccaaauaugaccaggugcuuaaggauguauugacaccacaauucaccaaaucuaaaaagagccgcaaaacaggagaaaucucacagacugucgaggacuuugaaguggugcuggguaaggucauguacagacaguuaguuauugauggcgacaaaaaguucaugcucgggaguuccaccuaucaguacaacgcaaaacaacuggugcuuucugaugagagcguaaagacgcuggccuccaagggaaaacuagacgaggcucaggaaucagcggccuaugauaauguguacgacgagauacucgauaaggucgacagguacuuugcacuguaugaucagcggaacuaccgaaccaacuugcaugaaggcgagcagaaauucaucggucugcccuuacacgacacauuugaugggagcaagaaaguggcuaauggcaagagagagacuauuagugacauccucaacggacugcaugccaaugccaccaugacaaaccuuaagguucugggcauuucuuccccuuucgggauguuccaaagccacggacccaucaauuugaacccagaaacuauaauccucugucagucgccuaccggccuguuugagcgcaggauuauccuacgugaccuguga

SEQ ID NO: 3123 - RNA, 4113 nt, Artificial Sequence
  Cas9 variant
augaagaaaagaaacuacaauaucggccuggacauugggaccagcuccauaggauggacaaucguggaugacaacgcccagauuaugagggcuaaggguaaaaauggcuaugggguccggaucuucgcagagggaaagacugccgcggaucgccgaggcuuucguacgaccagaaggcggcucaaacgcagaaaguggaggcuucggcuguugcaagaguucuuugaacccuacauuuuaccuaucgacgaaaacuucuuuaugcgccagaaggagucuaaucugguuccacaggauccgaacaaacacuucaaggguucaauacuauuuaaugaccgaacagaucaggaguuccaugaacaauaucccacuaucuaccaccucagauaugcucugaugaccgagcauaggcaguuugacgugcgggaaauuuacugggccauccaccauauuguaaaauaucgugggcacuuccuuaacaguacacuggcaagcaaguuuaaaggaggcgaguugcgccucgccgauaaguucgaaucccugaauaagcuguuucucagagugcaggcugagaccggcuucgaguuaucugaagacaacgucgauaaaaucaagacugugcugcuugacaaugggaaaucgagguuggaucggcagcgagagguucugaagauaguguaccuaacaucagaagacaaagacaccgagaagaaacgcaaggcagucgccacggaguucauuaaggcugugcucggacugaaaacuaaacuuuuuaucguacuggccaaaaacccuaccgcggaaacagauuggaaguucagcuuugacgcagaggauauugacgauaaauuggacaguaucuccgaacaacucacugaugacgaucacgagaucguugaacugauuucugagauacauagcaucauuaccuuaacagguguggucccagaaggcauggggcuguccgagucaaugaucgccaaguacgaccagcaccagcucgaucuuaagaaacugaagaguuugaugagagaccuagacgugaaacaggcuaggaagcugcaagaugccuaugacgaguacauagauggacucaaacccagcgaagaggcauucuauucugcuguguccucagucauucagaagauggacgauccucgggccaagaaaaucaccgcggaaaucgagcuggaagaguuuaugccaaagcagcgcacgaaagccaauggccaaauuccccaucagcuucaccagcaggagcuggaccaaaucauugaaaaccagaaggaguacuauccuugguuggcagaagagaauccaaacaaaagagagcacaacgcugccccgcauaagcucgauggucugguuacuuucagggugcccuacuauguagggccuuuaauagaagcuagcgugcagcagaagacaaguaauucuaacuuugccuggauggagcguaaagucaagaaugacaccucccggaucacuccauggaacuucgaagagaaaguggaucgaaaugcaagcgccgaaaacuuuauuaagagaaugacaaccaaagacacguaccugcuaaaugaggauguucucccccaacagucgcugcuuuaccagagguaugagguguugaacgaacugaauaacguccgcgugaaugacaagaaacucgagaacaauugcaagcaggauguauacaaggaccuguucaaaaacaauaccacaguuucuaucaagaaauuuaaggacuaucuuguggcuaacugugaauacgcggauaacccuaaaaucgagggacuggcagacgaauccauuuucuugucaagucucagcacugagaauaaguuuaaggauauauucggcgcccaaaucgacgauccaaacuauuucgaggacuuugaacacauuaucgagugggcuaccauuuucgaagauaauaaaauccugcgggccaaguuagacgagauauccuggcugaacgaaucucagaaaaaggagcuagcaaaacucagaaugaggggcugggggcgccugagccgaaaacuuaucgccgagauuacagaugaaaauggaucacggaucauugacuugcugugggagcauauggauaacuuuauggucguggucaaucaggacguguucaaggaaaagaucguugcugagaacaaacagguguuuaaggagcucaauccccuggauauaauuaacgaacaauucaccaguccgcagaauaagaaagccuuacgucagauccugcuuguagucgcagacauucaaaaggcgaugaacggugugacuccuuccaauaucuuuauagaguucgcuagagaagacgagaggaacccccgccggagcauccagagauugaggcagguugaaaauauguaccgagauauuucugacacagugcucgccgauccagagguccgcaacgagcugucaaacaucaagaauaccgaacuagcacgggacagaguguuucuguauuuccuccagggcgggagggauguauacacuggagagccucugaacauugacaaacuuagugaauacgauaucgaccacauauugccccaagccuuuauuaaggauaauagccuggacaaccguguguuaguuuccgcuucucucaaucgcucgaaaagcgauuccgucccacuggacgacuucacgucagagauguuuggccggaagauggaaccccuuugggagcagaugcagagagccggucugaucaguaaaaagaaauuggcaaaccucaaguucaauccugagaacaucaauaaguauacaaggaacggguucauuaaucgacagcugguggaaacccggcaagugaucaaacuagcugccaacauucugaaggaucauuacggcgaggaaacugagauagucaauguuaaagcgggacucacccaccaguuucgcaaggacuucgauuuuccaaagaacagaaaugugaacaacuaucaccaugccuucgacgcuuaccugacagcacuugugggcaccuauuugcugaagaaguacccgaaauuagaaucuuauuuuguauacgggaaguucaaaaagggagaugguaucacuaaucucaaaaacuuuaauuuccugcacggcuuuaacaagcccgggaagauuaucaauaaagagacaggagagauucuuuucgacagggauaagcagcugggcuacaugaacagcaucuaugaccuacggaaagucauagugacgcaugaacucuccacccgacacggugccauguacgaucagacucuguauaaggcuucagacgauaaagacagcgggagaggcggaaagcaauugauccgcaagaaagauaaucugccuacagagauuuacggcggguauaccggaucuacagacgccuuuauguccaucauuaggaugaagaaaaaggacaaauuauacuauaagguuaucggugugccaacucgugucgcacacgaagugcuccagagugauggcaagauaaacauuuucacccugaauaaauucaucgagcagaaacuuacgaaggagaagguuaacaaaaagaccggggcgaucacacggauuacugacugguuugaacuggugauagccaaaguaauguacggacaagucaucgaugacggcggucagcccuucauguuggggagcucuacccucccuuacaaugugagagagcuguaucuagcuaaggaucuggugaaggucauuaacaaaggcuccacaucaaagaguagcuaccuugacguuuaugaugaacucgugaaaucgcugaauaaguacuuuccaauguaugacaggaacauguuccgccagaaaaucacugaugcccgagacaaguuugagaaguugcccaaaagagauaagguauccaauggaaaacugcagcaaauuggccaggugaccaucauagaccggaucuuaauugggcuccauacgaacgcaggagucucuaaucugaaggaucuuggcaucgcuacaccguucgguuuuaugcagcaggggaacggaauuagccugaccucaacugccaaaaucauauaccaaaguuccacaggcuuguucgaaaagucuaaggcacucgacgaccugaacccucuagccuga

SEQ ID NO: 3124 - RNA, 4113 nt, Artificial Sequence
  Cas9 variant
augaacaagcccuacagcaucggccuggacauugggaccaauuccgugggauggucuauaaucacagaugacuauaaagucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauaggauucuguaccuacaggaaaucuuugcugaggaaaugucaaaaguggacgauaguuucuuucacagacucgaggacagcuuccugguagaagaggauaagcggggcuccaaauauccaauauuugccacuaugcaagaggaaaaguacuaucaugagaaauucccgaccaucuaccaccuucgcaaggaacuggcagacaagaaagagaaggccgauuugcgacucauuuaccuggcucuggcacauaucauuaaauuuagaggucacuuccucaucgaggacgauagguuugacgugcggaacacagacauacagaagcaguaucaggccuucuuagaaauuuuugauaccacuuucgagaauaacgaccugcuuucucaaaaugucgauguggaagcuaucuugacagacaaaauuucgaagucagccaaaaaggaucguauccuggcgcgcuaccccaaccaaaagagcaccgggaucuuugcagaguuccuaaaacucauuguuggaaaucaggccgacuucaagaaacauuuuaaccuggaagauaagacgccucuucaguucgcuaaagacaguuaugaugaggaccuggagaauuugcucggccagauaggcgaugaauuugccgaccuguucuccgcagcuaagaaguuauacgacucugugcugcucagcgggauccuuacugucaccgaucuguccacaaaagccccauugucagcgaguaugauucagagauaugacgagcacagggaagaucuaaagcagcugaaacaguuugugaaggccagccuccccgagaaauaccaagaaaucuucgcagacucuuccaaggauggauaugcugguuacauagagggcaagacuaaccaggaggccuuuuacaaauaucugucaaagcugcugaccaaacaggaagggagcgaguacuugcucgaaaagauuaaaaaugaggacuuccugcggaagcaacgaacauuugauaacggaaguaucccucaccagguacauuuaaccgaacugcgcgcuaucauuagaaggcagucugaguauuacccauuccuaaaggagaaccucgaccggaucgaaaagauucugacguuucgcauacccuauuacguuggcccucuugccagagagaaguccgauuucgcauggaugacuaggaaaacagacgauagcauccguccauggaauuuugaagacuugguggauaaggagaaaucggccgaggcuuucauucaccggaugaccaacaaugaccuguaucucccggaagagaagguccugcccaaacauucucuuaucuacgaaaaguucacuguguacaacgagcugacaaaggugcgauuuuuggcggaagguuucaaagacuuucaguuccucaauagaaagcaaaaagagaccaucuuuaacucccuguucaaggagaaaaggaaggucacggaaaaggauauuauaucauuuuuaaauaaaguugacggguaugagggaaucgcaauuaagggcaucgaaaaacaguucaacgccagucugagcaccuaccacgaucuaaagaaaauucucggcaaggacuuucuggauaauacagacaacgagcuuaucuuggaagauauagugcagacucugacccucuucgaggaccgcgagaugauccggaagagacuggauauuuauaaagacuuuuucacagaaucccaguuaaagaaacuguacaggcgccacuauacuggguggggacgacuuucugcuaaguugaucaaugguauucggaacaaagagaaucaaaagaccauccucgauuaccugauagacgauggcagcgccaaccguaauuuuaugcagcuaauuaaggacgcagggcugucauucaaaccuaucauugacaaggccagaacaggaagucauuccgauaaccucaaagaaguagugggcgagcuggcugguagcccagccaucaagaaagggauacuucagucuuugaagaucgucgacgaacuggugaaaguuaugggcuaugagcccgagcagauuguggucgaaauggcaagggagaaccaaaccacugcgaagggauuaucacgccuccggcagagacugacgacacuuagggaaagucuggcuaaucuuaagagcaacauccucgaggagaaaaagccuaaauacgugaaggaucagguagaaaaucaccaucuguccgacgaucgacuauuccuguacuaucuccagaacggcaaagacauguacaccgaugacgagcuggauauugacaaucuuucucaauaugauaucgacuugauaauuccacaggccuuuaucaaggacgauucgaucgacaaccgcguucuggugagcuccgcaaagaaucgggggaaaucagaugacguccccaguguggaaauugucaaggauugcaaaguguucuggaagaaauuacucgacgccaagcugaugucucagagaaaguacgauaaccuuacuaaagcugagaggggaggucugaccagcgacgauaaggcccguuuuauccaacgccagcuaguugaaacacggcagauuaccaaacacguggcaagaauacucgacgagagguucaauaacgagcuggauuccaagggccgacggauccgcaaaguaaagauugucacuuugaagucaaaucuggugagcaacuuuagaaaagaguucggguuuuauaagaucagggaaguuaauaacuaccaucacgcucacgacgccuauuuaaaugcgguggucgccaaagcuauucucacaaaguacccgcagcuggaaccugaguucguguacggagauuaucccaaauacaacucuuauaagacgcggaaguccgcaaccgaaaaauuguuuuucuacaguaacaucaugaauuucuucaagacuaaaguaacacuggccgacggcaccgugguugucaaggacgauauagaggugaacaaugacacaggugagaucgugugggauaaaaagaaacauuucgcuacuguccgaaagguuuugagcuauccacaagugaacauugugaagaaaaccgaaauccagaccgggggcuuuucuaaggaguccauucucgcccacggaaauucagacaaacugaucccuagaaagacgaaagauauauaccuagaccccaagaaguauggcggguucgauaguccaauuguagcauacagcguccuggugguugcggacaucaaaaagggaaaagcccagaaacuuaaaacagugacugaacuccuggguaucaccauuauggagcgcucgagguuugaaaagaaccccuccgcuuucuuggagucuaagggcuaccugaauauacgugaugacaaauuaaugauccucccuaaguauagccuguuugagcuugaaaacgggcggagaaggcuguuggccucagcagaugagcuccagaaaggaaaugaacuggcucuaccaacacaauucaugaaguuucuguaccuugccagucgcuauaacgagcucaaaggcaagccggaggaaauugagcagaagcaggaauuugucgugcagcauguuuccuacuuugacgauauccugcaaauuaucaaugacuucucuaaccgagugauauuggcagacgccaauuuagagaaaaucaacaagcuguaucaggauaauaaagaaaacauucccguagacgagcucgcuaacaauaucauuaaccuguuuacuuucaccagccuuggugcgccugccgcauuuaaguucuucgauaaaaucgucgacagaaagcgguacacguccacaaaagaggugcuuaauucaaccuugauacaccagagcauuacugggcuauaugaaacaaggaucgaucugggcaagcucggagaggacuga

SEQ ID NO: 3125 - RNA, 4113 nt, Artificial Sequence
  Cas9 variant
augaccaagaaaaacuacagcaucggccuggacauugggacaaauuccgugggaugggccgucauaacugaugacuauaagguucccgcuaaaaagaugaaagugcucgguaacacggauaagaaguacaucaaaaagaaucuucugggcgcauuguuauucgacucuggggagaccgccgaagcgacaagacugaaaaggacugcucggcgccgauauacccguagaaagaacaggcuacgguaccuccaggagauuuuugccgaagagaugacaaaaguagaugaaucauucuuuuaucgccuggacgagaguuuccuuaccacugaugagaaggacuuugaaagacacccuaucuucggaaauaaggcagaggaagaugccuaccaucaaaaauuuccaacaauuuaucaccugaggaacuacuuggcugacagcuccgagaaggcagaucuccggcugguguaccuggcccucgcucauaugaucaaauaucgcggccacuucuuaauagaggguaagcugaaugccgaaaacaccgacguccagaaacuuuuuacggauuucguggggguuuacgaccgaacuuuugacgauucucauuugucggagaucaccguggacgucgcgucaacacugacugaaaagauuagcaaaaguagaaggcuagagaaucucaucaaguauuacccgaccgaaaagaaaaacacacuguucggaaaucuuauugcacuggccuugggccuccagcccaacuuuaagaugaauuucaaacuguccgaggaugcuaaguuacaguucucuaaagacaccuaugaggaagaucuggaggaacuccuuggcaagaucggggacgauuacgccgaccuguuuacgagcgcaaagaacuuguaugaugcuauacuacuguccgguauucucacuguggacgauaauucaacaaaagccccucugagugcgagcaugaucaagcgguacguagagcaccacgaagaccuugagaaacugaaggaguucauuaaagccaacaagucugaauuguaccaugacaucuuuaaggauaaaaacaagaauggauaugcaggcuacaucgagaacgggguuaaacaagacgaguucuauaaguaccucaaaaauacccuguccaagauugauggaucagacuauuuucuugauaagauagaacgugaagacuuccugcgcaaacagagaacuuuugauaacggcagcaucccacaccagauucaucuacaggagaugcacgcuauccucaggcggcaaggugacuacuaucccuuccugaaggagaaacaggaucgaauagaaaagauucuuacauuucgcaucccuuacuacguggggccauuggucagaaaagacaguagguucgccugggcugaguaucggucugaugaaaagaucacccccuggaauuuugacaaagugauugauaaggagaaguccgccgagaaauucaucacgcgcaugacccugaacgaccucuaccugccugaagagaaggugcuuccaaaacacagccaugucuaugaaacauacgcaguuuauaaugagcugacuaagauuaaauacgugaacgaacagggaaaggagucguuuuucgacucuaauaugaagcaggagauauucgaucacguauuuaaagaaaacagaaaggugaccaaagagaaguugcucaauuaucugaacaaagaguucccggaauacaggaucaaggacuuaauuggccuggauaaggaaaauaaauccuuuaacgccucacuaggcacauaccaugaccucaagaaaauccuggauaaggcuuuccuugacgauaaagucaaugaggaggugaucgaagacauuauaaagacuuugacccuguuugaggauaaggacaugauccacgaacgucuccaaaaauauagugauauuuucacagcgaaccagcugaagaaauuagagcggcgacauuacaccggguggggaagacugagcuauaaguuaaucaacgguauuaggaauaaagaaaacaauaagacuaucuuggacuaccucauagaugacggcuccgcaaaccgcaauuuuaugcagcugaucaacgacgauacgcuacccuucaaacaaauuauccagaagucucagguugugggggacgucgaugacauugaggccgugguacacgaucugccuggaagcccagcuaucaagaaaggcauacuccagucaguuaagauuguggacgagcuggucaaagugaugggugauaaucccgacaacaucgucauugaaauggcccgggagaaucaaacaaccaacagagggaggagucagucccagcagcgccuuaagaaauugcaaagcucucugaaggaauuaggcucaaauauccucaacgaggagaagccuaguuauauagaagauaaaguggagaauagccaucugcagaacgaccagcuuuuucuguacuauauccagaauggaaaggauauguacacuggcgacgaauuggacauugaucaccucuccgacuacgauaucgaccacauuaucccacaagcauucauaaaagaugacucuauugauaaccgaguucugaccucgagcgccaagaaccgggggaaauccgacgaugugcccucacuagacaucguacgugcuagaaaggccgagugggucaggcuguauaagaguggacucaucucuaaacgcaaguuugauaaucugacaaaagcagaacgggguggccuuaccgaggcggacaaggcuggguucauuaaaagacaguugguggagacuaggcagaucacaaagcauguugcccagauucuggaugcacgauuuaacacggaacacgacgagaaugacaaggugauacgcgaugucaaagugaucaccuuaaagagcaaccucguaucccaauuccggaaagacuucgaauuuuacaaggugagagagauuaaugauuaucaccaugcccacgacgcuuaccugaacgccguugucggaacugcacuucugaaaaaguauccgaagcuagcuucagaguucguguacggcgaauauaaaaaguacgauaucaggaaauuuauuacaaauagcucugacaaggccaccgcgaaauacuucuuuuauuccaaccucaugaauuucuuuaagacaaaagugaaguacgccgaugguacugucuucgagcguccuaucauagaaaccaacgcugacggggagaucgcauggaauaagcagauugauuuugaaaaaguucgcaaggugcugaguuauccccaggugaacaucguaaagaaggucgagacgcaaaccggcggauucagcaaagaaucuauuuugccaaagggcgacuccgauaagcugaucccucggaaaacaaagaaaguguacugggacacuaagaaauaugggggauuugauucacccaccguugccuacaguguguucgucguggcugacguugagaaggguaaggccaaaaaguuaaaaacagugaaggagcucguaggcauaagcauuauggaaagaucguucuuugaggaaaauccagucgaguuccuggagaacaaaggguaucauaauaucagggaagacaaacuuaucaagcugcccaaauacuccuuguuugaguucgaaggaggccgacggcgccuccuggcaucugcgagcgagcuacagaaggguaacgaaauggugcugccuggguaccuuguggagcuccuguaucacgcccauagagcugauaacuuuaauucaacugaguacuugaacuaugucagugaacacaaaaaggaguucgaaaaaguucuguccugcguggaggacuuugccaauuuauacguagauguggaaaagaaccucucuaaaauuagggcagucgcugacagcauggauaauuucuccauagaggagaucucaaacagcuuuauuaaucugcuuacccugacggccuugggcgcaccagccgacuucaacuuucucggagaaaagaucccgcggaagcgauauacaaguaccaaagagugucugacugcuacacuaauucaccagucuaucaccggccuguacgaaacuagaauagaucuuuccaagcucggggaggaauga

SEQ ID NO: 3126 - RNA, 4113 nt, Artificial Sequence
  Cas9 variant
augaagaacgccaauaaagugaccggcaaguacuaucugggguucgacaucggaacaaacagcgucgguugggcuguuacugaugagaauuacaaccucugcaaauuuaagaaaaaguccauguggggcauuagacuuuucgaagacgcaaagacggccgaggaaaggcgggggcagcgcgcgucucgacguagacugcaaaggcggaaacagcgcauagauuuguuacaggagaucuuugcugaagagauuaauaagguggacgagaccuucuuuaucagacugaacgaaucaaggcuacaccucgaugacaaaacaguaagugagaagcauccccuguucauuggaagcgaauauuccgagaaagaguacuaucgggaauacccuacuaucuuucaccuucgcaaggagcugauggaaucuucggagccacaugauauacgauugguguaucucgccauccaccauauucugaagaauagaggccacuuccugaucgacggugaacucucaaaagcaaacagcuuugaugccgcuuucuaccagaugaaggaggucuuauguaaugagcuggaccuugaaauugauggggagaacaccacagaaguggagaggaccuugcgggaccguaauaucaguaaauccgauaagguuaaacugcuagcagcccuccuggcuaugaaccaaaaugaaacugagucuaaggagacaaagaagaagauagaaaacauuugcaaacuucuggccggaaauaagggcgacaucagcaaaauuuuuggccagaccccggaggggguggaaaagacguccuucucauuuggagaggcggacuacgaugaaaguauccgccccaacuuggaggagagcaucccugaccaguguuucgucauugauucuauaaaagcacucuaugacuggaacgugcuggccgauaucuuaaauggucagacuuaccuguccugcgcuaagguaaaccaauaugaaacccacaagaauaaccucaaagagcuuaagcuguugguuaauagauacuguucaagggaagaguauaaacgguucuuuaagagcgccguggagaaagcaaacuacaguaauuauauuggcucugcuaagcaggggaacaagaucauagacgucaaacgaugcgccgaagaggauuucuacaaggaacuaaaaauucugcucuccaagaucgagccagaagaggcggaccgcgagcuguacgaaagaaucaaaagggaggccgaagagggaagccuucugcccuugcagcggaauaaggauaacucgguggugccuaaucagaugcauaaggcagaacucgcucugauuuuagagaacgccggcucuuaucuggguuuucuaaaugagaaagacgaagaugggcucuccccagcugagaagaucauugaacuguucucauuucgcauacccuacuaugucggaccucuuagugacagacacaaagacaggggcagcaacgccuggaucguucguaaggcagagggccggauuuugccauggaauuucgaugaaaaaguggaccgagagaaguccaacgaggccuuuaucgaaagaaugacaaacaaauguacuuaccugcucgggaaggauguaguggcuaaaaauucucugaucuauagccauuucaugguccuuaacgagcugaauaacuugucagugugcggaaauaaaauuaguguucaagugaagcaggacauauacagggaacucuuucagcgccacaccaaagucuccaagaaaaugcuguuacaauauugucgggagaagaugaugaacaaggaucuggaggaagaggaccuaagcgguuucgauggcgacuuuaaagcgaagcucucuucauaccuggauuucgagaaaaagguguuuggggcaaaaauggaagaagacagaaucaggaagauuacagaggauaucauucgcuggaagaccaucuacggagacgauggcaaaaugcuucaggccguaguugagaaggaauauccgggugaguuggacagugaccagcugaaagcugugaagcaguuccgauacagcggguggggcaauuucuccgaagaguuucucaacggaauagucggcacggaaaaacccacugggcaaauguucacaaucauugaggcccuguggcagaccaauugcaacuuaaugcagcugcuuucuaagaauuuuacuuucauggaggaaaucgagaagcacaaccgggaauuggcaggacagauuacagauaucucguaugacaaacucgugaaggaucuguacauaagcccugccaauaaacgugcugucuggcaaaccgugagaauugccgaggaaguuaagaaaaucauggguugugagccagcaaagauuuuuguggagauggcgaggggcggggaaaaagagaagaagcgcacgaucucccggaaaaagaaacuacuggaacucuaugcugccugcaagaaagacgcaagagauuggaacagggagauagaggaccgagaugaacgcgaguucaauucagacaagcuguaccuuuauuacacccagaugggacggugcauguacaguggcgaaagaaucgauuugcaugagcugaugucugccaacagcaagugggacauugaucacaucuauccccaguccaaaguaaaggacgauucauuagacaacaggguccucagccugaaaaagauuaauaacgaaaaagguaauaagccucuuucucgugacauccagcaaucccagcagaagugguggacagagcuguugcagcucgaguuuauaacuaaaaagaaauacgaucgccugaugcauagaggggaacuaagugaggaggaacugagcggcuucauuaaccggcaacucguggaaaccaggcagucuacaaaggcugccgcagagcugcuuggacgaauguauaauaacuccaaaguuguguacgucaaggcuccauuggugucacaguuucggaaggacgaucugaauaucuuaaaaagucgccucgccaacgacuaucaccaugcgaaggaugccuaccugaauaucgcuguaggcaacguguauaaugagaaauucacugacaacccccuuagauggauugaaaagcacgcaggggagaauuacagcaucaacaggguuuuugauuacgacauugucgccggagauggugcuccggugugggccgcaccucugcgggacgagaaaaauaagcuacgaaagaacgaagugggcgaaaaauaugggggaaccauagaugucaucagaaagacaguuaaacgcaacgacgugcucuacaccgagcacacuuauuguggcaagggugagcuguucaaugcgacgauugccaaaaaggacgggggcgcugaaauccccuugaaagccggacugcaaacaggcaaguacgggggauauaagucgccaaacaccuccuacuuugcagcuauugaguucgauggcaaaaagggugaaagggugaaaaauaucauggagguaccugucuauauagccaacaucuuacuccaugacauugaugcauacauccguuacugcgagacugugaaggggcugaaaaauguuaagauucuucggcccuguaucaagaaaaacgcccugauaucuguggacggauauccaaugagaauuaggggcgcuaaugaaaagaacaucuugcucaaaaauaaccugcagcccaucuucggucgccacgaggaaaccguccgaagaauugagaaguacguggagaaaaaucaggaauuugagguugaugaaaaguucgacggccuaaacgaggcgaaucugacagaucuuuaugacgauauaaccgaaaagcucugcgggccuuacguggagcggccaagcaaccagggagaauaucugauggagaauagggagaaauuuuugaacaucucacugaaggaaaaagccaaguuacucgcacaaaugauuaaacugguacgcugugacacugagacaaaggcugaucuucguaguaucggcgccuccaagaaugccggggucauuucugugaacaaaaacacgcugggaggcaagagauugauccucauaaaucagagcgugaccggucuguucgaaaaccggaucgagcuauga

SEQ ID NO: 3127 - RNA, 4113 nt, Artificial Sequence
  Cas9 variant
augaacaagcccuacagcaucggccuggacauugggaccaauuccgugggauggucuauaaucacagaugacuauaaagucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauaggauucuguaccuacaggaaaucuuugcugaggaaaugucaaaaguggacgauaguuucuuucacagacucgaggacagcuuccugguagaagaggauaagcggggcuccaaauauccaauauuugccacuaugcaagaggaaaaguacuaucaugagaaauucccgaccaucuaccaccuucgcaaggaacuggcagacaagaaagagaaggccgauuugcgacucauuuaccuggcucuggcacauaucauuaaauuuagaggucacuuccucaucgaggacgauagguuugacgugcggaacacagacauacagaagcaguaucaggccuucuuagaaauuuuugauaccacuuucgagaauaacgaccugcuuucucaaaaugucgauguggaagcuaucuugacagacaaaauuucgaagucagccaaaaaggaucguauccuggcgcgcuaccccaaccaaaagagcaccgggaucuuugcagaguuccuaaaacucauuguuggaaaucaggccgacuucaagaaacauuuuaaccuggaagauaagacgccucuucaguucgcuaaagacaguuaugaugaggaccuggagaauuugcucggccagauaggcgaugaauuugccgaccuguucuccgcagcuaagaaguuauacgacucugugcugcucagcgggauccuuacugucaccgaucuguccacaaaagccccauugucagcgaguaugauucagagauaugacgagcacagggaagaucuaaagcagcugaaacaguuugugaaggccagccuccccgagaaauaccaagaaaucuucgcagacucuuccaaggauggauaugcugguuacauagagggcaagacuaaccaggaggccuuuuacaaauaucugucaaaacuucugaccaaacaggaagggagcgaguacuugcucgaaaagauuaaaaaugaggacuuccugcggaagcaacgaacauuugauaacggaaguaucccucaccagguacauuuaaccgaacugcgcgcuaucauuagaaggcagucugaguauuacccauuccuaaaggagaaccucgaccggaucgaaaagauucugacguuucgcauacccuauuacguuggcccucuugccagagagaaguccgauuucgcauggaugacuaggaaaacagacgauagcauccguccauggaauuuugaagacuugguggauaaggagaaaucggccgaggcuuucauucaccggaugaccaacaaugaccuguaucucccggaagagaagguccugcccaaacauucucuuaucuacgaaaaguucacuguguacaacgagcugacaaaggugcgauuuuuggcggaagguuucaaagacuuucaguuccucaauagaaagcaaaaagagaccaucuuuaacucccuguucaaggagaaaaggaaggucacggaaaaggauauuauaucauuuuuaaauaaaguugacggguaugagggaaucgcaauuaagggcaucgaaaaacaguucaacgccagucugagcaccuaccacgaucuaaagaaaauucucggcaaggacuuucuggauaauacagacaacgagcuuaucuuggaagauauagugcagacucugacccucuucgaggaccgcgagaugauccggaagagacuggauauuuauaaagacuuuuucacagaaucccaguuaaagaaacuguacaggcgccacuauacuggguggggacgacuuucugcuaaguugaucaaugguauucggaacaaagagaaucaaaagaccauccucgauuaccugauagacgauggcagcgccaaccguaauuuuaugcagcuaauuaaggacgcagggcugucauucaaaccuaucauugacaaggccagaacaggaagucauuccgauaaccucaaagaaguagugggcgagcuggcugguagcccagccaucaagaaagggauacuucagucuuugaagaucgucgacgaacuggugaaaguuaugggcuaugagcccgagcagauuguggucgaaauggcaagggagaaccaaaccacugcgaagggauuaucacgcagucggcagagacucacgacacugagggaaagccuugcuaaucugaaguccaacaucuuggaggagaaaaagccuaaauacgugaaggaucagguagaaaaucaccaucucucugacgaucgacuguuccuauacuaucugcagaacggcaaagacauguacaccgaugacgagcucgauauugacaaucugucgcaauaugauaucgaccacauaauuccacaggccuuuaucaaggacgauagcaucgacaaccgcguucuuguguccucagcaaagaaucgggggaaaagugaugacguccccucuguggaaauugucaaggauugcaaaguguucuggaagaaauugcuggacgccaaguuaaugagccagagaaaguacgauaaccucacuaaagcugagaggggaggucugaccuccgacgauaaggcccguuuuauccaacgccagcuuguugaaacacggcagauuaccaaacauguggcaagaauacuggacgagagguucaauaacgagcuagauucaaagggccgacggauccgcaaaguaaagauugucacucucaagagcaaucuggugucuaacuuuagaaaagaguucggguuuuauaagaucagggaaguuaauaacuaccaccacgcucaugacgccuauuugaaugcgguggucgccaaagcuauucugacaaaguacccgcaguuagaaccugaguucguguacggagauuaucccaaauacaacuccuauaagacgcggaagagugcaaccgaaaaacucuuuuucuacagcaacaucaugaauuucuucaagacuaaaguaacacuggccgacggcaccgugguugucaaggacgauauagaggugaacaaugacacaggugagaucgugugggauaaaaagaaacacuucgcuacuguccgaaagguucuuucuuauccacaagugaacauugugaagaaaaccgaaauccagaccgggggcuuuuccaaggagucaauucuggcccauggaaauagugacaaauugaucccuagaaagacgaaagauauauaccucgaccccaagaaguauggcggguucgauagcccaauuguagcauacucgguccuggugguugcggacaucaaaaagggaaaagcccagaagcuaaaaacagugacugaacugcuugguaucaccauuauggagcgcuccagguuugaaaagaaccccucugcuuuccucgagagcaagggcuaccugaauauacgugaugacaaauugaugauccugccuaaguauucauuauuugagcucgaaaacgggcggagaaggcugcuugccagugcaggagagcugcagaaaggcaaugaauuggcucucccaacacaauucaugaaguuucuguaccuagccucccgcuauaacgagcugaaagguaagccggaggaaauugagcagaagcaggaauuugucgugcagcacguuucuuacuuugaugacauccuucaaauuaucaaugauuucagcaaccgagugauacucgcagacgccaaucuggagaaaaucaacaaguuguaucaggacaauaaagaaaacauucccguagaugaguuagcuaacaauaucauuaaccuguuuacuuucaccucccucggggcgccugccgcauuuaaguucuucgacaaaaucgucgauagaaagcgguacacgucaacaaaagaggugcugaauagcacccuuauacaccagaguauuacuggccuguaugaaacaaggaucgacuugggaaagcuaggcgaggauuga

SEQ ID NO: 3128 - RNA, 4113 nt, Artificial Sequence
  Cas9 variant
augaccaagaucaaagacgauuacauugugggccuggacauagggacagauagcugcggaugggucgccaugaacuccaauaacgacauccucaaacuucaggguaaaacugcuauuggcucuagacuguucgaagggggaaagucagcagccgaaaggcgguuguuucgcacgacccaccgacguaucaaaagaaggcgguggcgcuuaaagcugcuagaggaguucuuugaucccuauauggcggagguugacccuuacuucuuugcuagacucaaggaaaguggccugagcccacuugauaaaaggaagacaguguccucuauuguauucccgacuucggccgaggacaaaaaguuuuaugaugacuaccccaccaucuaucaucugcgguacaaauugaugacagaggaugaaaaguucgaccuccgcgagguguaucuggcaauacaccauaucauuaaguaccgagguaauuuucuguacaacaccucagucaaagauuucaaggccagcaaaaucgacgugaagaguuccauugaaaaacucaaugaguuauaugagaaccuggggcuugacuugaauguugaauuuaacaucucuaauacugcugagauagaaaaggugcugaaagauaagcaaauuuucaagagagacaaagucaagaaaaucgcagagcuauuugccauuaagacagauaacaaagaacagagcaagaggaucaaggacaucuccaaacagguggcuaaugccguacucggauacaagacccgguucgauacgauugcgcugaaagagauaucaaaggacgagcuuagugauuggaacuucaaacugagcgacaucgaugcagacucuaaguuugaagccuugaugggcaaucucgaugagaacgaacaggcuauucuguuaacuaucaaggagcuguucaaugaaguuacccucaacggcauaguggaggacgggaacacacuuuccgagucaaugauuaauaaauauaacgaccaccgugaugaccugaaguugcuaaaagaagucaucgagaaucauaucgaucgcaagaaagccaaggaacuggcacucgcuuacgaccuguaugugaacaauagacacggaaggcuucugcaagccaagaaaaaguuggguaaaauuaagccucggagcaaagaggauuuuuacaagguggucaacaaaaaucucgacgauagucgagcgucuaaggaaaucaagaaaaagauugagcuggacuccuucaugccaaaacagcgcacuaacgccaauggcguuauacccuaucaguuacagcaacuggagcuagauaagaucauugaaaaccagagcaaauacuacccuuuucucaaggagaucaauccagugucgucucaccugaaggaagcacccuauaaacuugacgaguugaucagauucaggguaccuuacuauguggggccacugauuuccccgaacgagucaaccaaggauauacagacuaaaaagaaucagaacuuugcuuggaugauccggaaagaagagggacgcauuacccccuggaauuucgaccaaaaggucgauagaaucgaaagugccaacaaguuuauuaaaaggaugacgacuaaggacacauaccucuucggcgaggacgugcugccugcuaacagccuucuguaucagaaauuuaccguuuugaaugaacucaacaauauccguauaaacgguaagcggaucuccguggaucugaaacaggagauuuacgagaauuuauucaagaagcauacuacagucaccgugaaaaagcuggaaaacuaucuaaaagagaaucacaaccucguaaagguugaaaucaaagggcuggccgacgagaagaaauuuaauucuggacuuacgaccuacaaccgauucaagaauuugaacauuuucgauaaucaaaucgacgaucugaaguacagaaacgacuuugaaaagauaauugaguggagcacaaucuucgaggauaagucaauuuauaaagaaaagcucaggaguaucgacuggcugaaugagaaacagauaaacgcauuauccaacauccgccugcagggcuggggccggcuuagcaagaaguugcucgcccagcugcaugaucacaaugggcaaacuauuaucgaacagcuaugggacucucagaacaauuuuaugcagauugugacccaagcugauuucaaagacgcgaucgcaaaggccaaccagaaucugcucgucgcuacaucaguggaggauauacugaacaaugccuacacaaguccagcaaacaaaaaggccauuagacaggucaucaaagugguugacgacaucgugaaggcugccagcggaaagguacccaaacagauugcaaucgaauuuaccagggaugcggacgagaauccuaagcgcucccaaacacgagguucuaaacuucagaaggucuauaaagauuugucgaccgagcuggcuagcaagacuauugccgaagaguuaaacgaagcaauaaaggacaaaaagcucgugcaggauaaauacuaucuguacuucaugcagcuuggccgggacgccuauacgggggagccaaucaauauugaugagauccaaaaguacgacauugaucacauccugccccaguccuuuauaaaagacgaugcuuuggacaaccguguucucgugucaagagccgucaauaacggaaagagugacaaugugccgguaaagcuguucggcaacgaaauggcagcuaaccuagguaugacaaucaggaaaaugugggaggaauggaagaauauugggcugaucucuaaaaccaaguacaacaaucuccugacugauccugaccauauuaacaaauauaagagcgccggcuuuauccgccggcagcuuguggagaccucccaaauaauuaaauugguuucaacaauccugcagagcagauaccccaauaccgaaaucauuacugucaaggcgaaguauaaccacuacuuaagggagaaauucgaucucuauaagucucgagaggugaaugacuaccaucacgccauagaugcuuaucuguccgcaaucuguggaaaccuucuguaccagaauuacccaaaccuacgccccuuuuucguguauggccaguacaaaaaguuuaguagcgacccugauaaagaaaaggagauuuucaauaagacacggaaauucucuuuuaucucccaaauucucaagaacaaaucagaaaauaguaaggagaucgccgaaaaacugaagagagcuuaucaguucaaguacauguuggucagcagggagacggagaccaaagaccaggaaauguuuaagaugacuguuuucccacgugagacacccgggaaccugauaccuaaaaagaaaggaauggccccagaaaucuaugguggcuacaccaaaaauucggaugcauauauggugauugugaagaucgacaagaagaaagagacagaauaccgcauuuuagggaucccgacucgggagcucguaaaccugaagaaagcggagaaggaagaucauuacgaguccuaucuuaaagaaauacuggcccccagaauuuuguacaauaagaacggaaagagggacaaaaagaucaccucuuuugagaucgucaaaagcaagauuccuuauaaacaggugauccaagauggcgacaagaaguucaugcucgguucaaguacguacguuuauaacgcuaaacagcugacccuauccacagagucuaugaaggccauaacuaauaacuuugacaaagauagcgacgaaaaugaugcacugauuaaggcuuacgacgagauccuugauaaaguggacaaguaucucccacuguucgauauuaacgccuuucgaaagaaauugcacuccgggcgggaaaaguucgucgagcugucauuagaagacaaaaaggauaucauacucaaagugcugauuggccuucacgacaaucccgcaaccagcgaucugaagacauugggauuuaguucuacugagcucggcaagaugcagaaaaacuccgggaucguucugagcggaaaugccaagcuaaucuaccagucgccuaccggucuguucaaaaagucagugaaaauuucugaccuuuga

SEQ ID NO: 3129 - RNA, 4113 nt, Artificial Sequence
  Cas9 variant
augaccaagaucaaagacgauuacauugugggccuggacauagggacagauagcugcggaugggucgccaugaacuccgacaaugauauccucaaacuucaggguaaaacugcuauuggcucucaccuguucgaggcagggaagucagccgcggacagaagguuguuucggacgacccaucgccgaaucaaacguagaagguggcgguuaaagcugcuagaagaguucuuugaucccuauauggcuaagguugacccuuacuucuuugcccgccucaaagaaaguggacugagcccacuugauaagagaaagaacguguucuccauuguauuuccgacagcagccgaggacaagaaauucuaugaugacuaccccacuaucuaucaccugagguacaaguugaugaccgaagaugagaaguuugaccuccgggagguguaucuggcuauacaucacaucauuaaauaccgcggcaauuuccuguacaacacaucugucaaggacuuuaaagcaucgaagaucgaugugaaaucaagcauugaaaagcucaaugaguuauaugaaaaccugggucuugacuugaauguugaguucaacaucaguaauaccgccgagauagaaaaagugcugaaggauaagcaaauuuuuaaacgagacaaggucaaaaagaucgcugagcuauucgccauuaaaacugauaacaaggaacaguccaagagaaucaaagacaucucuaaacagguggcgaaugcaguacucggguacaaaacaagguucgauaccauugcccugaaggagguuagcaaagacgaacuuuccgauuggaacuuuaagcugucagacauagaugcugacaguaaguucgaggccuugaugggaaaucucgacgagaacgaacaggcaauccuguuaacgauuaaagagcuguuuaaugcugugacucucaacggcaucgucgaagauggcaacacccuuagcgagucuaugauaaauaaguauaacgaccaucgggaugaccugaaauugcuaaaggaagugauugagaaucacaucgaucguaaaaaggccgugaagcuggcgcucgccuacgaccuguaugucaacaaucgccacgggcaacuuauccaggcaaagaagaaacugggaaagauuaaaccugguuccaaggaggauuucuacaaaguugugaacaagaauuuggacgauucacaggcuagcaaggaaaucaaaaagaaaauugagcucgacaguuuuaugccaaagcagagaacaaacgccaauggcguaauacccuaucaacugcaucaguuagaacuggauaaaaucauugagaaccagucuaaguacuacccuuuccuaaaggaaaucaauccaguguccagccaccucaaagaggcucccuauaagcuggacgagcuuaucagguuucgggucccuuacuauguggggccauugauuucgccgaacgaaucuacuaaagauauacagaccaagaaaaaucaaaacuucgccuggaugauccgaaaggaggaaggacgcauuacacccuggaauuuugaccagaagguugacagaaucgaguccgcaaacaaauucauuaagaggaugaccacgaaagauacuuaccuguuuggcgagaacgugcucccugccaauucacugcuuuaucagaaguucacaguccugaacgaauugaauaacauccggauaaaugguaaacgcaucaguguggaccucaagcaagagauuuacgaaaaccuguuuaagaaacauaccacuguaacaguuaagaaauuagagaauuaucugaagcagaaccacaaucuagugaaagucgaaaucaaggggcucgcugaugagaaaaaguucaacagcggacugaccacguacaauagauucaagaaccuuaauauuuuugacaaccagaucgaugacuugaaauacaggaaggauuucgagaaaauaauugaaugguccaccaucuuugaggacaagucuauuuauaaagaaaagcugcguagcaucgauuggcucaaugagaagcagauaaacgcgcugucaaacauccgguuacaaggcuggggccgacugaguaaaaaguugcuugcacagcuccacgaccauaaugggcagacaauuaucgaacagcugugggauucccaaaacaauuucaugcagauugugacucaggccgacuuuaaagaugcuaucgccaaggcaaaccagaaucuacuggucgccaccagcguggaggacauacucaacgacgcuuacacaucuccagccaauaaaaaggcaauuagacaaguuaucaaggugguagaugacaucgucaaagcggcuucaggaaaggugcccaaacagauugccaucgaguucacuagggaugcagacgauaacccuaagcgcagucagacccgggguagcaaacugcagaagguuuauaaggaccuuuccacagaauuggccucuaaagcuauugccgaggaacugaaugaggcaauaaaggauaaaaaguuagugcaagacaaauacuaucucuacuuuaugcagcugggcagagaugcuuauaccggggaaccaaucaacauugacgagauccagaaguacgauauugaccacauccuuccccaaucguucauaaaggacgaugcccuggacaauagggucuuggugagcaaagcgguaaacaaugauaaguccgacaacgugccgguuaaacucuuuggaaaugagauggccggcaaccuggguaucacuauucgcaagaugugggaagaguggaaaaacaucgggcuaauuucaaagacgaaauacaauaaccugcucacagauccugaccauaucaauaaguaugaaagugcuggcuucauacgacggcagcuggucgagaccucucagauuaucaaacuugugagcacuaucuugcagucccguuaccccaacaccgagauuauaacagugaaagcaaaguauaaucacuaccugagagaaaaauuugauuuauauaagucaagggaggucaacgacuaccaucacgccaucgaugcuuaucucagcgccauuuguggaaaucugcuuuaccaaaacuacccaaaucugcgcccuuucuuuguuuauggccaguacaaaaaguucucuuccgaccccgauaaggaaaaagagaucuucaacaagacccggaaauuuaguuucauuagccagauccuaaagaauaaaucugaaaacuccaaggagauagcagagaagcucaaaagagcguaucaguuuaaguacaugcuggugucaagggaaacugagacaaaagaccaagaaauguucaagaugacgguguuuccacgagagacccccgggaauuugaucccuaaaaagaagggaauggccacugaaauuuaugguggcuacacaaagaacagugaugcuuauaugguaaucgucaagauugacaaaaagaaagagaccgaguaccgcauccuggggauaccaacacgggaauuagugaaucucaagaaagccgagaaggaagaccacuacgagagcuaucugaaggaaauucuugcaccgagaauccuguacaacaaaaauggaaagagggauaaaaagaucacuucguucgagauuguuaaauccaagauccccuauaaacaggugauacaggacggcgauaaaaaguuuauguuggguucuagcaccuacgucuauaacgcuaaacagcucacgcugucaaccgagaguaugaaggccauuacaaacaauuucgacaaagauuccgacgaaaacgaugcacuaaucaaggccuacgacgagauucuggauaagguggacaaauaucuuccucucuuugauaucaaugcuuuccguaagaaacugcauucugggcgcgaaaaguuuguugaguugagccuggaggacaaaaaggauauaauuuuaaaggugcucaucggccugcacgacaacccagcgacuuccgaccuuaaaacccugggauucucaagcacagaauugggcaagaugcaaaagaauagugggaucguacucucuggaaacgccaagcugauuuaccagucccccacuggucuauucaaaaagagcgucaaaaucucggaucuguga

SEQ ID NO: 3130 - RNA, 4113 nt, Artificial Sequence
  Cas9 variant
augaacaagcccuacagcaucggccuggacauugggaccaauuccgugggauggucuauaaucacagaugacuauaaagucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauaggauucuguaccuacaggaaaucuuugcugaggaaaugucaaaaguggacgauaguuucuuucacagacucgaggacagcuuccugguagaagaggauaagcggggcuccaaauauccaauauuugccacuaugcaagaggaaaaguacuaucaugagaaauucccgaccaucuaccaccuucgcaaggaacuggcagacaagaaagagaaggccgauuugcgacucauuuaccuggcucuggcacauaucauuaaauuuagaggucacuuccucaucgaggacgauagguuugacgugcggaacacagacauacagaagcaguaucaggccuucuuagaaauuuuugauaccacuuucgagaauaacgaccugcuuucucaaaaugucgauguggaagcuaucuugacagacaaaauuucgaagucagccaaaaaggaucguauccuggcgcgcuaccccaaccaaaagagcaccgggaucuuugcagaguuccuaaaacucauuguuggaaaucaggccgacuucaagaaacauuuuaaccuggaagauaagacgccucuucaguucgcuaaagacaguuaugaugaggaccuggagaauuugcucggccagauaggcgaugaauuugccgaccuguucuccgcagcuaagaaguuauacgacucugugcugcucagcgggauccuuacugucaccgaucuguccacaaaagccccauugucagcgaguaugauucagagauaugacgagcacagggaagaucuaaagcagcugaaacaguuugugaaggccagccuccccgagaaauaccaagaaaucuucgcagacucuuccaaggauggauaugcugguuacauagagggcaagacuaaccaggaggccuuuuacaaauaucugucaaaacuucugaccaaacaggaagggagcgaguacuugcucgaaaagauuaaaaaugaggacuuccugcggaagcaacgaacauuugauaacggaaguaucccucaccagguacauuuaaccgaacugcgcgcuaucauuagaaggcagucugaguauuacccauuccuaaaggagaaccucgaccggaucgaaaagauucugacguuucgcauacccuauuacguuggcccucuugccagagagaaguccgauuucgcauggaugacuaggaaaacagacgauagcauccguccauggaauuuugaagacuugguggauaaggagaaaucggccgaggcuuucauucaccggaugaccaacaaugaccuguaucucccggaagagaagguccugcccaaacauucucuuaucuacgaaaaguucacuguguacaacgagcugacaaaggugcgauuuuuggcggaagguuucaaagacuuucaguuccucaauagaaagcaaaaagagaccaucuuuaacucccuguucaaggagaaaaggaaggucacggaaaaggauauuauaucauuuuuaaauaaaguugacggguaugagggaaucgcaauuaagggcaucgaaaaacaguucaacgccagucugagcaccuaccacgaucuaaagaaaauucucggcaaggacuuucuggauaauacagacaacgagcuuaucuuggaagauauagugcagacucugacccucuucgaggaccgcgagaugauccggaagagacuggauauuuauaaagacuuuuucacagaaucccaguuaaagaaacuguacaggcgccacuauacuggguggggacgacuuucugcuaaguugaucaaugguauucggaacaaagagaaucaaaagaccauccucgauuaccugauagacgauggcagcgccaaccguaauuuuaugcagcuaauuaaggacgcagggcugucauucaaaccuaucauugacaaggccagaacaggaagucauuccgauaaccucaaagaaguagugggcgagcuggcugguagcccagccaucaagaaagggauacuucagucuuugaagaucgucgacgaacuggugaaaguuaugggcuaugagcccgagcagauuguggucgaaauggcaagggagaaccaaaccacugcgaagggauuaucacgcagucggcagagacucacgacacugagggaaagccuugcuaaucugaaguccaacaucuuggaggagaaaaagccuaaauacgugaaggaucagguagaaaaucaccaucucucugacgaucgacuguuccuauacuaucugcagaacggcaaagacauguacaccgaugacgagcucgauauugacaaucugucgcaauaugauaucgaccacauaauuccacaggccuuuaucaaggacgauagcaucgacaaccgcguucuuguguccucagcaaagaaucgggggaaaagugaugacguccccucuguggaaauugucaaggauugcaaaguguucuggaagaaauugcuggacgccaaguuaaugagccagagaaaguacgauaaccucacuaaagcugagaggggaggucugaccuccgacgauaaggcccguuuuauccaacgccagcuuguugaaacacggcagauuaccaaacauguggcaagaauacuggacgagagguucaauaacgagcuagauucaaagggccgacggauccgcaaaguaaagauugucacucucaagagcaaucuggugucuaacuuuagaaaagaauuuggguuuuauaagaucagggagguuaauaacuaccaccacgcucaugacgccuauuugaaugcgguggucgccaaagcuauucugacaaaguacccgcaguuagaaccugaguucguguacggagauuaucccaaauacaacuccuauaagacgcggaagagugcaaccgaaaaacucuuuuucuacagcaacaucaugaauuucuucaagacuaaaguaacacuggccgacggcaccgugguugucaaggacgauauagaggugaacaaugacacaggugagaucgugugggauaaaaagaaacacuucgcuacuguccgaaagguucuuucuuauccacaagugaacauugugaagaaaaccgaaauccagaccgggggcuuuuccaaggagucaauucuggcccauggaaauagugacaaauugaucccuagaaagacgaaagauauauaccucgaccccaagaaguauggcggguucgauagcccaaaaguagcauacucgguccuggugguugcggacauuaagaaaggaaaggcccagaaacuaaagacagugacugaacugcuugguaucaccaucauggagcgcuccagguuugaaaagaaccccucugcuuuccucgagagcaaaggcuaccugaauauucgugaugacaaguugaugauacugccuaaauauucauuauuugagcucgaaaacgggcggagaaggcugcuugccagugcaggagagcugcagaagggcaaugaauuggcucucccaacacaauucaugaaauuucuguaccuagccucccgcuauaacgagcugaaggguaagccggaggaaaucgagcagaaacaggaguucgucgugcagcacguuucuuacuuugaugacauucuucaaaucauuaaugauuucagcaaccgagugauccucgcagacgccaaucuggaaaagauaaacaaauuguaucaggacaauaaggaaaacauccccguagaugaguuagcuaacaauauuaucaaccuguuuacuuucaccucccucggggcgccugccgcauuuaaauucuucgacaagauugucgauagaaaacgguacacgucaacaaaggaggugcugaauagcacccuuauccacaagaguauaacuggccuguaugaaacaaggauugacuugggaaaacuaggcgaggauuga

SEQ ID NO: 3131 - RNA, 4113 nt, Artificial Sequence
  Cas9 variant
augaacaagcccuacagcaucggccuggacauugggaccaauuccgugggauggucuauaaucacagaugacuauaaggucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauaggauucuguaccuacaggaaaucuuugcugaggaaaugucaaaaguggacgauaguuucuuucacagacucgaggacagcuuccugguagaagaggauaagcggggcuccaaauauccaauauuugccacucuucaagaggaaaaggacuaccaugagaaauucucuaccaucuaucaucugcgcaaggaauuggcagauaagaaagagaaggccgaccuccgacugauuuacaucgcucuggcacacauuaucaaauuuagaggucacuuccucauagaggaugacucguuugacgugaggaacacagauauuucaaagcaguaccaggacuucuuagaaaucuuuaauaccacuuucgagaacaaugaucugcuuagccagaacgucgacguggaagccauuuugacagauaaaaucaguaaguccgcuaaaaaggaccggauccuggcccaauauccgaaucagaagucuaccgggauuuuugcggaguuccuaaaacucauaguuggaaaccaggcagauuucaagaaauacuuuaaucuggaagacaagacgccccuucaguucgccaaagauagcuaugacgaggaucuggagaacuugcucggccaaaucggcgacgaauuugcugaccuguucuccgccgcaaagaaguuauacgauucagugcugcucagugggauucuuacugucaucgaccugagcaccaaagcuccuuugucugccuccaugauacagcguuaugaugagcaucgcgaagaccuaaagcagcugaaacaguuugugaaggcgucacucccagagaaauaccaagaaauuuucgccgauagcaguaaggacggauaugcagguuacaucgagggcaagacaaaucaggaggcuuuuuacaaauaucugucuaaacuucugacuaagcaggaagauuccgagaacuucuuggaaaagaucaaaaacgaggacuuucucagaaagcaaaggaccuucgauaaugggagcauuccccaccagguacaccugacagaauuaaaggccaucauucggcgacagucggaguacuauccuuuucugaaagagaaccaggaccgcauagaaaagauccuaaccuucaggauuccauacuauaucggaccccucgcuagagagaaaucugauuuugccuggaugacgcggaagacugacgauuccauccgcccuuggaauuucgaagaccugguugacaaagagaagucagcagaggccuucauucauagaaugacaaacaaugauuuuuaccuuccagaagagaaaguguugccgaagcacagucugauauaugaaaaguucaccgucuacaacgagcucacuaaagugagguacaagaaugaacaaggcgagacauacuuuuucgacagcaacaucaaacaggagauuuuugaugguguguucaaggaacaucguaaagucuccaagaagaaacugcuugacuuucuggcuaaggaguaugaagaguuccggaucguugaugugauuggguuggacaaagaaaauaaggcguuuaacgcaucucucggaaccuaucacgaucuggagaaaaucuuagacaaggauuuccuggacaaucccgauaacgagagcauacuagaagacaucguacagacgcucacccuguuugaggaucgagaaaugauuaagaaaagacuugagaauuacaaggacuuguucacagaaucacagcugaaaaagcucuauaggcgccacuacacuggcuggggccggcugagugccaaauuaaucaacgggauuagagacaaggagucccaaaagaccauccuggauuaucuuauagacgauggaaggagcaaucgcaacuuuaugcaguugauuaacgacgauggucucucuuucaaaucaaucauuaguaaggcucaggccggcagccauuccgacaaucugaaagagguggucggggaacuagcaggaucuccugccaucaagaaaggcauacugcagucgcucaagaucguggaugagcugguuaaagugauggguuacgaaccagagcaaauugucguggagauggcucgagaaaaccagacaacuaaucaggggcggcguaacagcagacagagguacaaacuuuuggacgauggcguaaagaaucuggccuccgacuuaaacggaaauauccucaaggaguaucccaccgauaaccaagcacugcagaaugaacgccuuuuccuguacuauuugcagaacggccgggacauguacacaggggaggcgcucgacauugauaaucugucacaauaugacaucgaucacauaauuccucaggcuuuuaucaaggacgauaguaucgacaacagaguucuagugucuagcgccaaaaauaggggaaaguccgaugacgucccaucacuggaaauugugaaagauugcaaggucuucuggaagaaacuccuggacgcaaaacuuaugagccagcgaaaguacgauaacuugaccaaggccgagcgcgguggccugacuucugacgauaaagcucgguuuauccagagacaauuaguggagacgaggcagauuacaaagcauguugcccguauacucgacgaacgcuucaauaacgagcuggacuccaaggggcggagaaucaggaaagugaagauuguaacccuuaaaaguaaccuggucagcaauuuucgaaaggaguucggauuuuauaaaauccgggaagugaacaauuaccaccaugcacacgaugcuuaccuaaacgccguuguggcgaaggccauucucacuaaguauccccagcuggaaccggaguucgucuacggcgacuauccuaaauacaauucuuauaagacccgcaaauccgcuacagagaaguuguuuuucuacucaaacaucaugaacuuuuucaaaaccaaggugacucuggcagaugguacaguagugguuaaggacgauauagaagucaauaaugacacgggggagaucgugugggauaaaaagaaacacuucgccaccgugagaaaggucuuaaguuauccccagaacaauauuguuaaaaagacugaaauccaaacaggcggauuuagcaaagagucgauucucgcucauggcaacuccgacaagcugaucccaaggaagaccaaagauauauaccuugacccuaagaaauacgggggauucgauucucccauuguggccuauagcgugcugguagucgcagacaucaagaaagguaaggcgcagaaguugaaaacagugacugaacuccugggcaucaccauuauggagcggucacgauuugagaagaauccaagugccuuccuagaauccaaaggguaccugaacauaagagcugauaaacuuaucauucuccccaaguauucucuguuugaguuggaaaauggacgcaggcgucuguuagccagcgcaggcgagcuccagaaggguaacgagcuggcccuuccuacgcaguucaugaaguuucuguacuuggcuucccgguauaacgaaucaaaagggaagccagaggaaaucgagaaaaagcaagaguucguuaaucagcacgugagcuacuuugacgacauucuccagcugaucaacgauuucaguaaaagagucauacuagcagacgccaaucuggaaaagaucaacaaacuuuaucaagauaauaaggagaacauuucuguggacgaacucgcuaauaacaucauuaaucuguuuaccuucacauccuugggcgcgccggccgcauuuaaguucuucgauaaaaucguugacaggaagcgcuacacuagcaccaaagagguguuaaacucgacacugauacaucagucaauuacuggacucuacgaaacccgaaucgaucugggcaaacuuggggaggacuga

SEQ ID NO: 3132 - RNA, 4113 nt, Artificial Sequence
  Cas9 variant
augaacaagcccuacagcaucggccuggacauugggaccaauuccgugggauggucuauaaucacagaugacuauaaggucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauaggauucuguaccuacaggaaaucuuugcugaggaaaugucaaaaguggacgauaguuucuuucacagacucgaggacagcuuccugguagaagaggauaagcggggcuccaaauauccaauauuugccacucuucaagaggaaaaggacuaccaugagaaauucucuaccaucuaucaucugcgcaaggaauuggcagauaagaaagagaaggccgaccuccgacugauuuacaucgcucuggcacacauuaucaaauuuagaggucacuuccucauagaggaugacucguuugacgugaggaacacagauauuucaaagcaguaccaggacuucuuagaaaucuuuaauaccacuuucgagaacaaugaucugcuuagccagaacgucgacguggaagccauuuugacagauaaaaucaguaaguccgcuaaaaaggaccggauccuggcccaauauccgaaucagaagucuaccgggauuuuugcggaguuccuaaaacucauaguuggaaaccaggcagauuucaagaaauacuuuaaucuggaagacaagacgccccuucaguucgccaaagauagcuaugacgaggaucuggagaacuugcucggccaaaucggcgacgaauuugcugaccuguucuccgccgcaaagaaguuauacgauucagugcugcucagugggauucuuacugucaucgaccugagcaccaaagcuccuuugucugccuccaugauacagcguuaugaugagcaucgcgaagaccuaaagcagcugaaacaguuugugaaggcgucacucccagagaaauaccaagaaauuuucgccgauagcaguaaggacggauaugcagguuacaucgagggcaagacaaaucaggaggcuuuuuacaaauaucugucuaaacuucugacuaagcaggaagauuccgagaacuucuuggaaaagaucaaaaacgaggacuuucucagaaagcaaaggaccuucgauaaugggagcauuccccaccagguacaccugacagaauuaaaggccaucauucggcgacagucggaguacuauccuuuucugaaagagaaccaggaccgcauagaaaagauccuaaccuucaggauuccauacuauaucggaccccucgcuagagagaaaucugauuuugccuggaugacgcggaagacugacgauuccauccgcccuuggaauuucgaagaccugguugacaaagagaagucagcagaggccuucauucauagaaugacaaacaaugauuuuuaccuuccagaagagaaaguguugccgaagcacagucugauauaugaaaaguucaccgucuacaacgagcucacuaaagugagguacaagaaugaacaaggcgagacauacuuuuucgacagcaacaucaaacaggagauuuuugaugguguguucaaggaacaucguaaagucuccaagaagaaacugcuugacuuucuggcuaaggaguaugaagaguuccggaucguugaugugauuggguuggacaaagaaaauaaggcguuuaacgcaucucucggaaccuaucacgaucuggagaaaaucuuagacaaggauuuccuggacaaucccgauaacgagagcauacuagaagacaucguacagacgcucacccuguuugaggaucgagaaaugauuaagaaaagacuugagaauuacaaggacuuguucacagaaucacagcugaaaaagcucuauaggcgccacuacacuggcuggggccggcugagugccaaauuaaucaacgggauuagagacaaggagucccaaaagaccauccuggauuaucuuauagacgauggaaggagcaaucgcaacuuuaugcaguugauuaacgacgauggucucucuuucaaaucaaucauuaguaaggcucaggccggcagccauuccgacaaucugaaagagguggucggggaacuagcaggaucuccugccaucaagaaaggcauacugcagucgcucaagaucguggaugagcugguuaaagugauggguuacgaaccagagcaaauugucguggagauggcucgagaaaaccagacaacuaaucaggggcggcguaacagcagacagagguacaaacuuuuggacgauggcguaaagaaucuggccuccgacuuaaacggaaauauccucaaggaguaucccaccgauaaccaagcacugcagaaugaacgccuuuuccuguacuauuugcagaacggccgggacauguacacaggggaggcgcucgacauugauaaucugucacaauaugacaucgaucacauaauuccucaggcuuuuaucaaggacgauaguaucgacaacagaguucuagugucuagcgccaaaaauaggggaaaguccgaugacgucccaucacuggaaauugugaaagauugcaaggucuucuggaagaaacuccuggacgcaaaacuuaugagccagcgaaaguacgauaacuugaccaaggccgagcgcgguggccugacuucugacgauaaagcucgguuuauccagagacaauuaguggagacgaggcagauuacaaagcauguugcccguauacucgacgaacgcuucaauaacgagcuggacuccaaggggcggagaaucaggaaagugaagauuguaacccuuaaaaguaaccuggucagcaauuuucgaaaggaguucggauuuuauaaaauccgggaagugaacaauuaccaccaugcacacgaugcuuaccuaaacgccguuguggcgaaggccauucucacuaaguauccccagcuggaaccggaguucgucuacggcgacuauccuaaauacaauucuuauaagacccgcaaauccgcuacagagaaguuguuuuucuacucaaacaucaugaacuuuuucaaaaccaaggugacucuggcagaugguacaguagugguuaaggacgauauagaagucaauaaugacacgggggagaucgugugggauaaaaagaaacacuucgccaccgugagaaaggucuuaaguuauccccagaacaauauuguuaaaaagacugaaauccaaacaggcggauuuagcaaagagucgauucucgcucauggcaacuccgacaagcugaucccaaggaagaccaaagauauauaccuugacccuaagaaauacgggggauucgauucucccauuguggccuauagcgugcugguagucgcagacaucaagaaagguaaggcgcagaaguugaaaacagugacugaacuccugggcaucaccauuauggagcggucacgauuugagaagaauccaagugccuuccuagaauccaaaggguaccugaacauaagagaugacaaacuuaugauccuccccaaguauucucuguuugaguuggaaaauggacgcaggcgucuguuagcuagcgccggcgagcuccagaaggguaacgagcuggcacuuccuacgcaguucaugaaguuucuguacuuggcuucccgguauaacgaaucaaaagggaagccagaggaaauugagaaaaagcaagaguucguuaaucagcacgugagcuacuuugacgauauccuccagcugauuaacgacuucaguaaaagagucauccuagccgaugcaaaucuggaaaagauaaacaaacuuuaucaagacaauaaggagaacaucucuguggaugaacucgccaauaacauuaucaaucuguuuaccuucacauccuugggcgcuccggcggccuuuaaguucuucgacaaaauuguugauaggaagcgcuacacuagcaccaaagagguguuaaacucgacacugauccaucagucaauaacuggacucuacgaaacccgaauugaccugggcaaacuuggggaggauuga

SEQ ID NO: 3133 - RNA, 4113 nt, Artificial Sequence
  Cas9 variant
augaacaagcccuacagcaucggccuggacauugggaccaauuccgugggauggucuauaaucacagaugacuauaaagucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauaggauucuguaccuacaggaaaucuuugcugaggaaaugucaaaaguggacgauaguuucuuucacagacucgaggacagcuuccugguagaagaggauaagcggggcuccaaauauccaauauuugccacuaugcaagaggaaaaguacuaucaugagaaauucccgaccaucuaccaccuucgcaaggaacuggcagacaagaaagagaaggccgauuugcgacucauuuaccuggcucuggcacauaucauuaaauuuagaggucacuuccucaucgaggacgauagguuugacgugcggaacacagacauacagaagcaguaucaggccuucuuagaaauuuuugauaccacuuucgagaauaacgaccugcuuucucaaaaugucgauguggaagcuaucuugacagacaaaauuucgaagucagccaaaaaggaucguauccuggcgcgcuaccccaaccagaaaagcaccgggaucuuugcagaguuccuaaaacucauuguuggaaaucaggccgacuucaagaaacauuuuaaccuggaagauaagacgccucuucaguucgcuaaagacaguuaugaugaggaccuggagaauuugcucggccaaauaggcgaugaauuugccgaccuguucuccgcagcuaagaaguuauacgacucugugcugcucagcgggauccuuacugucaccgaucuguccacaaaagccccauugucagcgaguaugauucagagauaugacgagcacagggaagaucuaaagcagcugaaacaguuugugaaggccagccuccccgagaaauaccaagaaaucuucgcagacucuuccaaggauggauaugcugguuacauagagggcaagacuaaccaggaggccuuuuacaaauaucugucaaagcugcugaccaaacaggaagggagcgaguacuugcucgaaaagauuaaaaaugaggacuuccugcggaagcaacgaacauuugauaacggaaguaucccucaccagguacauuuaaccgaacugcgcgcuaucauuagaaggcagucugaguauuacccacuacucaaggagaaccuggaccggaucgaaaagauucuuacguuccgcauacccuauuacguuggcccuuuggccagagagaaguccgauuuugcauggaugacuaggaaaacagacgauagcauccguccauggaauuucgaagaccugguggauaaggagaaaucggccgaggcuuuuauucaccggaugaccaacaaugaccucuaucugccggaagagaagguccuucccaaacauucucugaucuacgaaaaguucacuguguacaacgaguugacaaaggugcgauuccucgcggaagguuuuaaagacuuccaguuucugaauagaaagcaaaaagagaccaucuucaacuccuuauuuaaggagaaaaggaaggucacggaaaaggauauuauaucauuccugaauaaaguugacggguaugagggaaucgcaauuaagggcaucgaaaaacaguuuaacgccagucuaagcaccuaccacgaucucaagaaaauucugggcaaggacuuccuugauaauacagacaacgaguugauccuggaagauauagugcagacucucacccuguuugaggaccgcgagaugauccggaagagauuagauauuuauaaagacuucuuuacagaaucccagcugaagaaacuuuacaggcgccacuauacuggguggggacgauugucugcuaagcucaucaaugguauucggaacaaagagaaucaaaagaccauccuggauuaccuaauagacgauggcagcgccaaccguaauuucaugcagcugauuaaggacgcagggcucucauuuaaaccuaucauugacaaggccagaacaggaagucauuccgauaaccugaaagaaguagugggcgagcuugcugguagcccagccaucaagaaagggauauugcagucucugaagaucgucgacgaauuagugaaaguuaugggcuaugagcccgagcagauuguggucgaaauggcaagggagaaccaaaccacugcgaagggacucucacgcagucggcagagacugacgacacuuagggaaagccuggcuaauuugaaguccaacauccucgaggagaaaaagccuaaauacgugaaggaucagguagaaaaucaccaucugucugacgaucgacuauuccuguacuaucuccagaacggcaaagacauguacaccgaugacgagcuggauauugacaaucuuucgcaauaugauaucgaccacauaauuccacaggccuucaucaaggacgauagcaucgacaaccgcguuuugguguccucagcaaagaaucgggggaaaagugaugacguccccucuguggaaauugucaaggauugcaaaguguuuuggaagaaacuguuagacgccaagcucaugagccagagaaaguacgauaaccugacuaaagcugagaggggaggucuuaccuccgacgauaaggcccguuucauccaacgccagcugguugaaacacggcagauuaccaaacauguggcaagaauacuagacgagagguuuaauaacgagcucgauucaaagggccgacggauccgcaaaguaaagauugucacucuuaagagcaauuuggugucuaacuucagaaaagaauuuggguucuauaagaucagggagguuaauaacuaccaccacgcucaugacgccuaucugaaugcgguggucgccaaagcuauuuuaacaaaguacccgcagcucgaaccugaguuuguguacggagauuaucccaaauacaacuccuauaagacgcggaagagugcaaccgaaaaacuguucuuuuacagcaacaucaugaauuucuuuaagacuaaaguaacacuugccgacggcaccgugguugucaaggacgauauagaggugaacaaugacacaggugagaucgugugggauaaaaagaaacacuucgcuacuguccgaaagguucugucuuauccacaagugaacauugugaagaaaaccgaaauccagaccgggggcuucuccaaggagucaauuuuggcccauggaaauagugacaaacucaucccuagaaagacgaaagauauauaccuggaccccaagaaguauggcggguuugauagcccaauuguagcauacucgguccuagugguugcggacaucaaaaagggaaaagcccagaagcugaaaacagugacugaacuucucgguaucaccauuauggagcgcuccagguucgaaaagaaccccucugcuuuucuggagagcaagggcuacuuggauauacgugacgauaaacugaugaucuuaccuaaguauucacucuucgagcuggaaaaugggcggagaaggcuucuggccagugcaggagaguugcagaaaggcaacgaacucgcucugccaacacaauuuaugaaguuccuauaccuggccucccgcuauaaugagcuuaaagguaagccggaggaaauugagcagaagcaggaauuugucgugcagcacguuucuuacuucgacgauauccuccaaauuaucaacgacuuuagcaaucgagugauacuggcagacgccaacuuggagaaaaucaauaaguuauaucaggauaacaaagaaaauauucccguagacgagcuggcuaacaacaucauuaaucucuucacuuuuaccucccugggggcgccugccgcauucaaguuuuucgauaaaaucgucgacagaaagcgguacacgucaacaaaagaggugcuuaacagcacccugauacaccagaguauuacuggcuuguaugaaacaaggaucgaucuaggaaagcugggcgaggacuga

SEQ ID NO: 3134 - RNA, 4113 nt, Artificial Sequence
  Cas9 variant
augaagaaacccuacagcaucggccuggacauugggaccaacuccgugggaugggccgucguuacagaugacuauaaggugccugcuaaaaagaugagaguauucggugauacugacaggucucacauaaagaagaaucuccuuggcacgcuguuguuugaugacgggaacaccgcagagucacggcgcuuaaagcgaacagcccguagaagguacacucggcgcagaaauaggauccuguaucuacaggaaauuuucaccgagaguaugaacgaaaucgaugagagcuuuuuccaucggcucgacgauuccuuucuggugccagaagacaaacgcggaucuaaguacccgauuuucgcgacacuucaagaggagaaagaauaucacaagcaguuucccaccaucuaccaucugcgaaaacaguuggcugauucgaaggagaagucagacgucagacucauauaucuggcccuggcacacaugaucaaauacaggggccauuuccucuacgaagagacuuuugauauuaagaauaacgacauccagaaaauuuucaaugaguuuaucaacauauaugacaauacauucgaagguagcaguuuauccgggcaaaacgcccagguggaggcuauuuuuaccgauaagaucucuaaaagcgcaaagcgggaacguguucugaaacuuuucccugacgagaaguccacgggauuguucucagaauuucugaagcuaauugugggcaaucaggccgauuucaaaaagcacuuugaccucgaggagaaagcuccacugcaguucaguaaggauacuuacgacgaagaacuugaaaaccuguugggccaaaucggggaugacuuugccgaucucuuccugaucgcgaaaaaguuauaugacgcaauucugcucagcggaauacuuaccgucacagaucccucuacuaaggccccucuguccgcuucaaugaucgagcgcuacgaaaaucaccagaaagacuuggccgcacuaaagcaguuuauuaaaaacaaucugccagagaaguauguggagguauucagcgaccagaguaaagaugguuacgcuggcuauaucgacgggaagaccacacaagaagccuuuuacaaguacauuaaaaaccuccugucuaaguucgagggagcggauuauuuucuugacaaaauagaaagagaggauuuccugaggaagcagcggaccuuugacaacggcuccaucccccaucagauccacuugcaagaaaugaaugccauucuccgacgccagggugagcauuacccuuuccugaaagagaacagagaaaagaucgagaagauuuuaacguucaggauaccauauuacguugggccgcuggcacgggauaaucgcgacuuuagcuggcuaacuagaaacucggaugaacccaucaggccuuggaauuucgaggagguggucgacaaagcucguucugccgaagauuuuauucaccggaugacaaacuaugaccucuaccugccagaggaaaaggugcuucccaaacacuccuugcuguaugagaccuucgcuguguacaaugaacucacuaaggucaaauuuaucgccgagggacugcgagauuaccaguuccuugacucaggccagaagaaacaaaucguuaaccagcuguuuaaggagaagagaaaagugacagaaaaggacauuauacauuauuugcacaauguagauggcuacgacgggaucgagcucaaaggaauugaaaagcaguucaacgcaaaucugaguaccuaucaugauuuacugaaaaucacgaaggacaaggaguuuauggaugacccuaaaaacgaagagauucuagagaauaucgugcacacccucacaauauucgaagauagggagaugaucaagcagcgccuggcccaauacgacacucuuuuugaugaaaaagucauuaaggcuuugacccggagacauuauacagguuggggcaaacugagcgcgaagcucaucaacgggauuagggacaagcaguccggaaaaacuauccuggauuacuuaauagacgaugacaagauuaaucgcaacuucaugcagcugaucaacgacgauggccuuucuuuuaaagagauuauccagaaggcacaagugguugguaaaaccgacgaugugaagcaggucgugcaggaauugccagggagccccgccauaaagaaaggcauccuccagucaauuaagaucguagacgagcugguuaaagugaugggauaugcucuagagaguauugucaucgaaauggcccgagagaaucaaacaaccgcacggggcaagaaaaacucccagcagcguuacaagagaauagaagaugcccugaaaaaucucgcuccggggcuggacagcaacauucuuaaggagaauccuacugauaacauccaauugaagaaugacaggcuguucuuauacuaucuccagaacggaaaagauauguacacggguaagccccuggacaucaaucagcuuucuucauaugauauugaccacaucauuccacaggccuucauaaaagacgauaguaucgacaaccgcgugcugacaagcuccaaggauaaucggggcaaaucugacaacgucccuucguuggaggugguucaaaagagaaaggcauuuuggcagcagcuccuggauagcaaacuaauuuccgaaaggaaguucaauaaccugaccaaagcggagcgagggggacucgacgaacgcgauaaggugggcuuuauccggagacagcugguagagacucaacagauuaccaaaaaugucgcucagauccuugacgccagguucaacacagaagugaaggagaagaaccagaaaauacguaccguuaagaucauuacuuugaaaucaaaucuggugaguaacuuucgcaaggaguucgguuuauacaaaguccgggaaaucaauaacuaucaccaugcacacgaugccuaccucaaugcugugguagccaaggcaauucugaagaaauaucccaaacuugagccagaauuuguguacggggacuaccaaaaauaugaucugaagaaauacaucucuagauucaagcccagcaaggagauagaaaaagcuacagagaaguacuuuuucuauuccaaccuacucaacuuuuucaaagaggaaguucuguaugccgacggcacgauuaggaagcgagagaauaucgaauacucaaaagauaccggagagaucgcgugggacaaggaaaaagacuucgccacuauuaagaaggucuugagcuauccucaggugaauauagugaaaaagcgggagguccagacaggcggguuuucuaaagaguccauccugccaaagggaaacagugauaaauuaauuccgcgcaagaccaaggacauccucugggauacaacuaaauacgguggcuucgacagccccguuauugcuuacucuauccugcuuauagcagauaucgaaaaggggaaagccaagaaacugaagaccgugaagacguuggugggaauuaccaucauggagaaagcugccuuugaagagaauccuauuacauuccucgagaacaagggcuaucauaauguaagaaaagaaaacauccugugccuaccaaaguacucccuguuugagcuugaaaaugguaggcggcgacuccuggcaucagcgaaagaguugcaaaaggggaacgaaauaguccugcccguguguuuaacuacccuccuguaucacaguaagaaccuucacaaacuggacgagccugagcauuuggaauacauucagaagcacagaaaugaguucaaagaucuccugaaccuaguuagcgaauuuucgcagaaguauauccuggccgaggcuaaucuugagaaaaucaaggaccucuacgccgauaacgagcaggcagacauugagauccuggcuaauuccuucauaaacuuguuaacauuuacugcccugggcgcaccagccgcuuucaaauuuuucggaaaggauguggaccgcaagagguauaccacggucucugaaauucucaaugcgacacugauccaucaaagcauuaccggccuuuacgagacucguaucgaucugucaaaauugggggaagaguga

SEQ ID NO: 3135 - RNA, 4113 nt, Artificial Sequence
  Cas9 variant
augaagaaacccuacagcaucggccuggacauugggaccaacuccgugggaugggccgucauaacagaugacuauaagguuccugcuaaaaagaugaaagugcucgguaauacugauaagaacuacaucaagaaaaaucuucugggcgcauuguuauucgacucugggaacacggccgaggauagaaggcugaagcggaccgcgcgccgacguuauacaagaaggcggaaucgccuacucuaccugcaggacauuuucucagaugaaaugaacaaaguagacgagaguuucuuucacagacuugaagauagcuuccugguguccgaggacaagaggggagaucaucacccaaucuuuggcaaugucguggacgaaguuaaauaucaugagcaauucccgacuauuuaccacuugcggaaguaucucgcugauacccccgagaaggccgaccugcgccugguguaccucgcauuagcccauaugaucaaauuucgaggucacuuccugauagacgauccuaaacuugacgucaaaaacacagauucucaggaauuguuuucgcaguuccugaccgcuuacgacgugacucaggaggauucacaccuagcagacguaaagaucaauauuagcgauaucauuacagaaaagaugaacaagaguagaaaaguugaggcccuccuguuucauuucccaucccaaaagaagaauagcuuuuucgggaaccuugugucucuggucuucggauugcuccccaauuuuaaaaccaacuucaaucuggcugaggacgccaaguuacagcuguccaaagauucauaugacgaagaucucgagaaccuucugggccagaucggcgacgaauacacggacguguuuguggcggcaaggaaguuguaugauaguauacuacugagcgggauucucacugucaacgaccugucuaccaaagccauccuuuccgcuucaaugguucggcguuacgaggaacacaauaaggaucuggccaaguugaaagcauucgugaaggcuaacuuuacacaugacguauucaaagagguguuuagcgaugccaguaagaauggauaugcggguuacauugagggcaaaacuucucaggaagacuucuauaaguacgucaagaaccucaucgggaaaguggauggauccgccgacuuuaucgagaagauugaucgcgaagacuuccugagaaaacaaaggaccuuugauaauggcagcauaccucaccagguucacuuagcagagaugaaggcuauccugcggcgacagggugaauacuauccauuccuaaaagagcaugccgagaagauucagcaaauccucacauuucgcauacccuacuauguggggccucuggacagacacggacauucggauuucgcuugggccucuuucaacuccgaagagaaggucaccccauggaauuuugaagagauuaucgacaaaaacaagucagcacaggccuucaucgaaaggaugacgaaucaggaccuuuacuugccgaacgagaaagugcugcccaagcacaguccucucuaugagaaauacacuguauauaaugaacugacaaagauuaaauacguuaccgagacuggcacagcuaaguuuuucgaugcgaaccuuaagcaagaaaucuuugacggccuguucaaaaaggagcggaaagugaccaagcgcaaauugcucacguuucuggagaagaauuucgaugaauuuagaauugucgacauacagggguuagauaaggagaccgaaacauucaacgcaagcuacggaaucuaucaggaccugcuaaaaauuaucaaggauaaagccuuuauggacgauuccgagaaugcugacauccucgaagauauugugcugacucuuaccuuguucgaggacagggagaugauaaagcagcgucuggccaaauacgcagaucucuuugacaagaaggucaucgacaaccuggcccggcgaagauauacagguuggggcagguuaucugcuaaacugcuuaacgggauucgcgauaagcggagcagaaaaacuaucauggacuacuugguggaugacggaaggucaaaucgcaaccucaugcaacugauuaccgaugacaaucuaacauucaaggaugaaaucgccaaagcacaguauagugacaacuccgaugaccugcaucagguugugcaggaucucgcgggcagcccagcuauaaagaaggguauccugcaaucuguaaaaauugucgacgagcuugugaagguuaugggguacgaacccgagcagaucguggucgaaauggcccgagagaaucagaccacugcaaaaggccggcguaacucacagcaaagauauaagagguuggaggaagccauuaaaaaucuggaccgcgauuuaaacuacaagauccucaaagagcacccuacggacaaucaggcucugcagaacgaucggcuuuuccuguacuauuugcagaauggaagagacauguacacaggcgaaagucucgauauaaacaggcugagcgacuaugauauugaccacaucauuccacaagccuuuaucaaggauaauuccauagacaaccgagugcuaguaucuucggcaaagaaucgcgggaaaagcgaugacgugcccuccgaggauguugucaaccggaugagaccguucuggaacaagcugcucaauugcggacugaucucacagaggaaauacaguaaccuuaccaagaaagaauugacuccuaaugacaaggcugguuuuauuaagcgucagcugguggagacccgccaaaucacaaaacauguggcccggauuuuagacgagcacuucaacaaggaauuugaugaggacaaaaagagaaucaggaaagucaagguugugacccucaagucuaaucuggugagcaacuuccgaaaagaauuugagcuuuauaagguacgggagauaaaugauuaccaucacgcgcacgacgccuaucugaacgcugucguggcaaaagcccuacucaugaaguaccccaaacuggaaccagaguucguuuacggcgaauauccuaaguacaauuccuaucgcgagagaaagacugcuacacagaggauguuuuucuacucaaacauuaugaauauguuuaaaagcaaggugaaauuggccgaugaacggaucaucgagcgacccaugauugaggucaacgacgaaacgggggagaucgcaugggauaagaccaaacauauugcgacugugaagaagguucugucuuauccacagauaaauaucgugaaaaagguagaggaacagacaggaggcuuaaccaacgaaacaauuuaccccagagguuccuucgacaaacuccugaaucgcaagaacacucuugaggccaguaaauaugggggcuucggaagcccuaccgucgcuuacugugugcugguggucgccgauucuaagaacgagaauggcaaaguuaagaaguugaaacucggguccgaacugcuaggaaucacgauucuggagaagaacgacuuugaaaauaacucacuugauuuccucaguaggaaagguuaccaaggcgugcaggagaagaaaaucauaaagcugccaaaguauagcuuguuugaauuucaggacgggucgcgucggaugcuguccucuguaauggcaaaugauaacaaaagaggagacuuacagaaggcuaaugagaugauccucccggccuaccuggugaaacuucuguaucacgcaaagcauauuaacagcgucggcgagcccgcccacaaaaauuacaucaacgaacauugcucagaguuucaagacuugcucaauuauauuaggcaguucgcugauaaguuuguggacguugauaagaaccugaguaaaauccgcucccuaucuaagagcauggcggaauacuccgugucagagauauguagcaguuucgucaaucugcuuacccucacagcccugggugcuccugcagacuuuaaauucuuugggacuaccauuccacgaaagagauauggcucuccccaguccaucuugagcgccacauuaauccaccagucgauuacuggacuguacgagacccggauagaucucucaaaacugggcgaagacuga

SEQ ID NO: 3136 - RNA, 4113 nt, Artificial Sequence
  Cas9 variant
augaacaagcccuacagcaucggccuggacauugggaccaauuccgugggauggucuauaaucacagaugacuauaaagucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauaggauucuguaccuacaggaaaucuuugcugaggaaaugucaaaaguggacgauaguuucuuucacagacucgaggacagcuuccugguagaagaggauaagcggggcuccaaauauccaauauuugccacuaugcaagaggaaaaguacuaucaugagaaauucccgaccaucuaccaccuucgcaaggaacuggcagacaagaaagagaaggccgauuugcgacucauuuaccuggcucuggcacauaucauuaaauuuagaggucacuuccucaucgaggacgauagguuugacgugcggaacacagacauacagaagcaguaucaggccuucuuagaaauuuuugauaccacuuucgagaauaacgaccugcuuucucaaaaugucgauguggaagcuaucuugacagacaaaauuucgaagucagccaaaaaggaucguauccuggcgcgcuaccccaaccagaaaagcaccgggaucuuugcagaguuccuaaaacucauuguuggaaaucaggccgacuucaagaaacauuuuaaccuggaagauaagacgccucuucaguucgcuaaagacaguuaugaugaggaccuggagaauuugcucggccaaauaggcgaugaauuugccgaccuguucuccgcagcuaagaaguuauacgacucugugcugcucagcgggauccuuacugucaccgaucuguccacaaaagccccauugucagcgaguaugauucagagauaugacgagcacagggaagaucuaaagcagcugaaacaguuugugaaggccagccuccccgagaaauaccaagaaaucuucgcagacucuuccaaggauggauaugcugguuacauagagggcaagacuaaccaggaggccuuuuacaaauaucugucaaaguugcugaccaaacaggaagggagcgaguacuugcucgaaaagauuaaaaaugaggacuuccugcggaagcaacgaacauuugauaacggaaguaucccucaccagguacauuuaaccgaacugcgcgcuaucauuagaaggcagucugaguauuacccauuccuaaaggagaaccucgaccggaucgaaaagauucugacguuucgcauacccuauuacguuggcccucuugccagagagaaguccgauuucgcauggaugacuaggaaaacagacgauagcauccguccauggaauuuugaagacuugguggauaaggagaaaucggccgaggcuuucauucaccggaugaccaacaaugaccuguaucucccggaagagaagguccugcccaaacauucucuuaucuacgaaaaguucacuguguacaacgagcugacaaaggugcgauuuuuggcggaagguuucaaagacuuucaguuccucaauagaaagcaaaaagagaccaucuuuaacucccuguucaaggagaaaaggaaggucacggaaaaggauauuauaucauuuuuaaauaaaguugacggguaugagggaaucgcaauuaagggcaucgaaaaacaguucaacgccagucugagcaccuaccacgaucuaaagaaaauucucggcaaggacuuucuggauaauacagacaacgagcuuaucuuggaagauauagugcagacucugacccucuucgaggaccgcgagaugauccggaagagacuggauauuuauaaagacuuuuucacagaaucccaguuaaagaaacuguacaggcgccacuauacuggguggggacgacuuucugcuaaguugaucaaugguauucggaacaaagagaaucaaaagaccauccucgauuaccugauagacgauggcagcgccaaccguaauuuuaugcagcuaauuaaggacgcagggcugucauucaaaccuaucauugacaaggccagaacaggaagucauuccgauaaccucaaagaaguagugggcgagcuggcugguagcccagccaucaagaaagggauacuucagucuuugaagaucgucgacgaacuggugaaaguuaugggcuaugagcccgagcagauuguggucgaaauggcaagggagaaccaaaccacugcgaagggauuaucacgccuccggcagagacugacgacacuuagggaaagucuggcuaaucuuaagagcaacauccucgaggagaaaaagccuaaauacgugaaggaucagguagaaaaucaccaucuguccgacgaucgacuauuccuguacuaucuccagaacggcaaagacauguacaccgaugacgagcuggauauugacaaucuuucucaauaugauaucgaccacauaauuccacaggccuuuaucaaggacgauucgaucgacaaccgcguuuuggugagcuccgcaaagaaucgggggaaaucagaugacguccccaguguggaaauugucaaggauugcaaaguguucuggaagaaacuguuagacgccaagcucaugucucagagaaaguacgauaaccugacuaaagcugagaggggaggucuuaccagcgacgauaaggcccguuuuauccaacgccagcugguugaaacacggcagauuaccaaacauguggcaagaauacuagacgagagguucaauaacgagcucgauuccaagggccgacggauccgcaaaguaaagauugucacucugaagucaaauuuggugagcaacuuuagaaaagaguucggguuuuauaagaucagggaaguuaauaacuaccaccacgcucaugacgccuaucugaaugcgguggucgccaaagcuauuuuaacaaaguacccgcagcucgaaccugaguucguguacggagauuaucccaaauacaacucuuauaagacgcggaaguccgcaaccgaaaaacuguuuuucuacaguaacaucaugaauuucuucaagacuaaaguaacacuugccgacggcaccgugguugucaaggacgauauagaggugaacaaugacacaggugagaucgugugggauaaaaagaaacacuucgcuacuguccgaaagguucugagcuauccacaagugaacauugugaagaaaaccgaaauccagaccgggggcuuuucuaaggaguccauuuuggcccauggaaauucagacaaacucaucccuagaaagacgaaagauauauaccuggaccccaagaaguauggcggguucgauaguccaauuguagcauacagcguccuagugguugcggacaucaaaaagggaaaagcccagaagcugaaaacagugacugaacuucucgguaucaccauuauggagcgcucgagguuugaaaagaaccccuccgcuuuccuggagucuaagggcuacuugaauauacgugaugacaaacugaugaucuuaccuaaguauagccucuuugagcuggaaaacgggcggagaaggcuucuggccucagcagaugaguugcagaaaggaaaugaacucgcucugccaacacaauucaugaaguuucuauaccuggccagucgcuauaacgagcuuaaaggcaagccggaggaaauugagcagaagcaggaauuugucgugcagcacguuuccuacuuugacgauauccuccaaauuaucaaugacuucucuaaccgagugauacuggcagacgccaauuuggagaaaaucaacaaguuauaucaggauaauaaagaaaacauucccguagacgagcuggcuaacaauaucauuaaccucuuuacuuucaccagccugggugcgccugccgcauuuaaguucuucgauaaaaucgucgacagaaagcgguacacguccacaaaagaggugcuuaauucaacccugauacaccagagcauuacuggguuguaugaaacaaggaucgaucuaggcaagcugggagaggacuga

SEQ ID NO: 3137 - RNA, 4113 nt, Artificial Sequence
  Cas9 variant
auggagaagaacaaagaauacgugaucggccuggacauugggaccggaagcgucgguugguccgccauaucuacagauaauuaucagcucaucagacaaaagggcaaaaaccuuauugggguuaggcuguucaauucagcugagacugcagaagaacggcgcggauaccgaacgacccguagaagguugagucggcgcagauggaggaugagcuuacugaacgacaucuuucggcccgaacuaaaugagauugaugagaacuuccucgcccgccugaaguauuccugggugucuccucuugaccagaaaaauccacagcugaacgaacagggcacaaaugcgucguuguacggugauaucgaggcugaccaagccuuucaccgagcauauccgacuauauaccaucucagaaagacccugauggaagauaaccagaagcacgaccugagggagguauaucucgccauccaucacauugugaaauaccgggggcauuucuuaacacccgauuuugacgcuaauucacagaccaucgauauuaagggacuguucaaacagcuuggcgacgucagcggcaguaucgaguugcaagcagaucagacuuccacagugauagccgcuuuucagucuauucugcuagacuucaccaagacgccuacugaaagcgggcgucucgccggacagcuguuuuccgaccaaaacaaagauaagcaggcgaagaaacagguugaggaacuuuucaagcuguugcgcgguggcaaagggucacucgcagacauguuucuguuaaccgaucuggacaagguggucaaaaaucaacucaaguucgccuuugaugacgcuguggaugagaaccuuaaucugaucaguaacuugauuaacgaggagcaguacgagcuacugcucaauauccagaaacugagaggaacaaucauucuuaagcagauacugggcgacgaugaaacuguaagcgacgccaagguuaggucuuaugaggaacacgcacaccaauugaaagagcucaaggcucaggugcugaccaaagauaacaaggaaaaauucgaggaggccuaccaguuaauccagaagggugacgcgucccggauugacgggcugaagaaacuaaagacaaucauaaaucaagaacaugaggcccuccgacuggauaaauaugaagcagacaaacuuuugaaacugauugagcucgaucagcugcuuccaguccagcgcucaaagagaaacggagaaaucccccaccagcugcaugaguucgaguugaagaaaaucauugaaaagcaaggcagguacuauccuuuucuccgggagaccuucgaacgcgacggccaggaguuuaauaaaaucgggcagcuggugaacuucagaauaccauacuaugugggacccuuagucgauccuaggcuggcugguauacagagcggcgaccaaacgaaucacuggaugacucagaagaaagccgggaagaucacaccauggaacuacaccgagcuaauugauaucgacaagagugcugccgaauuuaucaaacguaugacuggaacagauaccuaccucguuggcgagccgucucugcacaaggcaucccuuauuuaucaggacuacaauguguugcaagaacugaacaaucuccgguaugaugguaaaccccugccuguagacgccaagcaggagauauacagcaacuuacaggugucgcugaaaaaugcuacgaagaacaaaaucaauucuuuccuuauuuccgaaggguauuugcaggauggcgaggagcucaccggauuugcgggcaaggaacugaagaacaaacuaucaaguuuccauuacuuuaagaacaucuucgggccagagcgaaugaauacacugggaacugacaaccucgaaaagauuaccgagcugcaaacagucuuugaagacagacacaugcuuaagaggcaguugcagaaacuggguuucuuagaugacgaugagugcgagaagcucgcaggcaagcauuuuacuggguggggaaaucugagcaaaaagcugcuuaacacccccgccaucauagacccugaaaucaaugagaacaaaauuuccuugaucgaugcucucuauaagggccagcgcaaucugucuuucuacgugaacaauauggacgauaaauaccaauuccgggacuggauugaaagcgagaaccagucacagcagguugaaaucagucuagaugagaagauaaagaaucuggccgguuccccagcaauuaaaagagggaucacacaaagcauggccgugauucaggacaucauaagggcuaacaauggcaucucucccaagcgcauuuaucucgaguuugcccgagaaucacagaacaguuaccaaccgaauagccggaucaaacagauugagaagaucuaugaucagaacaaaaaggaacugaugaaggucuacccugacguguucaaagauguacagggaguucuuaacaauguggacgagaacaauuccuugucugagaaggcauuucuguauuucaugcaauuaggcaaagacauguacaccggggaagcgcucgauuuugacaagcuguauacuuacgauauagaccacauuaucccccaggcuaugacgaaagauaacucgugggacaauaagguccuugugacagccaucaaaaaccgugaaaagagcaaucagguccuggauaacgcaauucaggccaagaugcauaauuucuggcuacaacucaaaaaggugaaccuguugucccagagaaaauacgacacccugaugaagacuaauuuuucaaaaggagaugaaaagaaguucaucgcuaggaguuuaguugagacccgccagauuauuaaaaacguggccgaacucaucaagucugaguuugaccacguagaggcaauuccaauccggcaggaacugacaagcgauaugagacaacuuauggacuauaaaaagaauaggcuggucaacgacuaccaccaugcucacgaugccuugcucauugcgaccgugggugaguucaugcagaaacgaggcuuuaugcaggggaugaauccuucccagaacguuuaucauggauacacucaauaugugaagaaguggcugucaauggccaaaaaggcucgcagcgcagaaaaacccgagcggaucuucccacuacaguuugucgugggcucuaugagaauggccguaagggacggucagguggauaagguuacacaccccgcuacgggggaaauauguuggaccgccgacaacgaggcauaccugcguaaaguccuuggcuauaagaauauccucgugacucgcaaggugaaaaacgcgggaaagcuguaccaacgggucacaguuaaaccuaagggcuccggggaggccccagugaaucaccagaaaagugauauuaacaucuacggaggcgugaccagcgaacaggcugccgaguugguacugauuagaaucaaggcaaagaauaacgcuaaaaauauggucauaaagauuccgacagccaucgcaaaccagguggccaauaaaacuaccacguaugacgcuuacguuaggucuuuaaacauccccaauuaugcggguauuauacucgaucaaaucccucuggggcagcuuguguucgacgaacgaaccuccuucuaccuggccucagcagagauuaagcauaacgcucggcaguugugggucaaucagcacaucaacaaugugcucacuaaaaagaacauuaaugaugaggagcgcgacaacauccugaaccuacugacaaaugagaaaaaccuugaaagauuuaagcuccuggagccagauuugaagaggguuaaagccgccaagcaacagugggcuaguugcgacgaucaggaacagaugcaaauauuacggaucauuaucaauaaaaugcaugacgacgcaagcccccagauuccuggaaagaucgauccauucaaaaacuaucuggacaagcagggcaaggguuggcgagaucucagaaccaaaaagggcaugaaacugucggacaaugccgaguuuguguaccaaucccccacagggcuuuaucaccgcaagauaucuauuaacgagcuguugaaacagaagcagcuagaauga

SEQ ID NO: 3138 - RNA, 4113 nt, Artificial Sequence
  Cas9 variant
augaacaagcccuacagcaucggccuggacauugggaccaauuccgugggauggucuauaaucacagaugacuauaaagucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauaggauucuguaccuacaggaaaucuuugcugaggaaaugucaaaaguggacgauaguuucuuucacagacucgaggacagcuuccugguagaagaggauaagcggggcuccaaauauccaauauuugccacuaugcaagaggaaaaguacuaucaugagaaauucccgaccaucuaccaccuucgcaaggaacuggcagacaagaaagagaaggccgauuugcgacucauuuaccuggcucuggcacauaucauuaaauuuagaggucacuuccucaucgaggacgauagguuugacgugcggaacacagacauacagaagcaguaucaggccuucuuagaaauuuuugauaccacuuucgagaauaacgaccugcuuucucaaaaugucgauguggaagcuaucuugacagacaaaauuucgaagucagccaaaaaggaucguauccuggcgcgcuaccccaaccaaaagagcaccgggaucuuugcagaguuccuaaaacucauuguuggaaaucaggccgacuucaagaaacauuuuaaccuggaagauaagacgccucuucaguucgcuaaagacaguuaugaugaggaccuggagaauuugcucggccagauaggcgaugaauuugccgaccuguucuccgcagcuaagaaguuauacgacucugugcugcucagcgggauccuuacugucaccgaucuguccacaaaagccccauugucagcgaguaugauucagagauaugacgagcacagggaagaucuaaagcagcugaaacaguuugugaaggccagccuccccgagaaauaccaagaaaucuucgcagacucuuccaaggauggauaugcugguuacauagagggcaagacuaaccaggaggccuuuuacaaauaucugucaaagcugcugaccaaacaggaagggagcgaguacuugcucgaaaagauuaaaaaugaggacuuccugcggaagcaacgaacauuugauaacggaaguaucccucaccagguacauuuaaccgaacugcgcgcuaucauuagaaggcagucugaguauuacccauuccuaaaggagaaccucgaccggaucgaaaagauucugacguuucgcauacccuauuacguuggcccucuugccagagagaaguccgauuucgcauggaugacuaggaaaacagacgauagcauccguccauggaauuuugaagacuugguggauaaggagaaaucggccgaggcuuucauucaccggaugaccaacaaugaccuguaucucccggaagagaagguccugcccaaacauucucuuaucuacgaaaaguucacuguguacaacgagcugacaaaggugcgauuuuuggcggaagguuucaaagacuuucaguuccucaauagaaagcaaaaagagaccaucuuuaacucccuguucaaggagaaaaggaaggucacggaaaaggauauuauaucauuuuuaaauaaaguugacggguaugagggaaucgcaauuaagggcaucgaaaaacaguucaacgccagucugagcaccuaccacgaucuaaagaaaauucucggcaaggacuuucuggauaauacagacaacgagcuuaucuuggaagauauagugcagacucugacccucuucgaggaccgcgagaugauccggaagagacuggauauuuauaaagacuuuuucacagaaucccaguuaaagaaacuguacaggcgccacuauacuggguggggacgacuuucugcuaaguugaucaaugguauucggaacaaagagaaucaaaagaccauccucgauuaccugauagacgauggcagcgccaaccguaauuuuaugcagcuaauuaaggacgcagggcugucauucaaaccuaucauugacaaggccagaacaggaagucaucucgauaaccugaaagaaguagugggcgagcuugcugguuccccagccaucaagaaagggauauugcagagccugaagaucgucgacgaauuagugaaaguuaugggcuaugagcccgagcagauuguggucgaaauggcaagggagaaccaaaccacugcgaagggacucucucgcucacggcagagacugacgacacuuagggaaagucuggcuaaucuuaagagcaacauccucgaggagaaaaagccuaaauacgugaaggaucagguagaaaaucaccaucuguccgacgaucgacuauuccuguacuaucuccagaacggcaaagacauguacaccgaugacgagcuggauauugacaaucuuucucaauaugauaucgaccacauaauuccacaggccuuuaucaaggacgauucgaucgacaaccgcguuuuggugagcuccgcaaagaaucgggggaaaucagaugacguccccagucuggaaauugugaaggauugcaaagucuucuggaagaaauuacucgacgccaagcugaugucucagagaaaguacgauaaccuuacuaaagcugagaggggaggucugaccagcgacgauaaggcccguuuuauccaacgccagcuaguggaaacacggcagauuaccaaacauguugcaagaauacucgacgagagguucaauaacgagcuggauuccaagggccgacggauccgcaaagugaagauuguaacuuugaagucaaaucuggucagcaacuuuagaaaagaauuuggguuuuauaagaucagggaggugaauaacuaccaccacgcucaugacgccuauuuaaaugcgguuguggccaaagcuauucucacaaaguacccgcagcuggaaccugaguucgucuacggagauuaucccaaauacaacucuuauaagacgcggaaguccgcaaccgaaaaauuguuuuucuacaguaacaucaugaauuucuucaagacuaaagugacacuggccgacggcaccguagugguuaaggacgauauagaggucaacaaugacacaggugagaucgugugggauaaaaagaaacacuucgcuacugugcgaaaggucuugagcuauccacaaguuaacauugugaagaaaaccgaagugcagaccgggggcuuuucuaaggaguccauccucgcccauggaaauucagacaaacugauuccuagaaagacgaaagauaucuaccuagaccccaagaaguauggcggguucgauaguccaauaguagcauacagcguccuggugguugcggacauuaaaaagggaaaagcccagaaacuuaaaacagugacugaacuccuggguaucaccaucauggagcgcucgagguuugaaaagaaccccuccgcuuucuuggagucuaagggcuaccugaauauucguacagauaaauuaauaauccucccuaaguauagccuguuugagcuugaaaacgggcggagaaggcuguuggccucagcaggagagcuccagaaaggcaaugaacuggcucuaccaacucaauacaugaaguuccuguaucuugccagucgcuacaacgagcucaaagguaagccggaggaaauugagcagaagcaggaauuugucgugcagcacguuuccuauuucgacgauauccugcaaauuaucaaugacuuuucuaaccgagugauauuggcagaugccaauuuagagaaaaucaacaagcuguaccaggacaauaaagaaaacauucccguagacgagcucgcuaacaauaucauuaaccuguucaccuuuacgagccuuggggcgccugccgcauucaaguuuuucgauaaaaucgucgacagaaagcgguauacauccaccaaagaggugcuuaauucaacuuugauacaccagagcauuacaggccuauacgaaaccaggaucgaucugggaaagcucggcgagggguga

SEQ ID NO: 3139 - RNA, 4113 nt, Artificial Sequence
  Cas9 variant
augaacaagcccuacagcaucggccuggacauugggaccaauuccgugggauggucuauaaucacagaugacuauaaggucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauaggauucuguaccuacaggaaaucuuugcugaggaaaugucaaaaguggacgauaguuucuuucacagacucgaggacagcuuccugguagaagaggauaagcggggcuccaaauauccaauauuugccacucuucaagaggaaaaggacuaccaugagaaauucucuaccaucuaucaucugcgcaaggaauuggcagauaagaaagagaaggccgaccuccgacugauuuacaucgcucuggcacacauuaucaaauuuagaggucacuuccucauagaggaugacucguuugacgugaggaacacagauauuucaaagcaguaccaggacuucuuagaaaucuuuaauaccacuuucgagaacaaugaucugcuuagccagaacgucgacguggaagccauuuugacagauaaaaucaguaaguccgcuaaaaaggaccggauccuggcccaauauccgaaucagaagucuaccgggauuuuugcggaguuccuaaaacucauaguuggaaaccaggcagauuucaagaaauacuuuaaucuggaagacaagacgccccuucaguucgccaaagauagcuaugacgaggaucuggagaacuugcucggccaaaucggcgacgaauuugcugaccuguucuccgccgcaaagaaguuauacgauucagugcugcucagugggauucuuacugucaucgaccugagcaccaaagcuccuuugucugccuccaugauacagcguuaugaugagcaucgcgaagaccuaaagcagcugaaacaguuugugaaggcgucacucccagagaaauaccaagaaauuuucgccgauagcaguaaggacggauaugcagguuacaucgagggcaagacaaaucaggaggcuuuuuacaaauaucugucuaaacuucugacuaagcaggaagauuccgagaacuucuuggaaaagaucaaaaacgaggacuuucucagaaagcaaaggaccuucgauaaugggagcauuccccaccagguacaccugacagaauuaaaggccaucauucggcgacagucggaguacuauccuuuucugaaagagaaccaggaccgcauagaaaagauccuaaccuucaggauuccauacuauaucggaccccucgcuagagagaaaucugauuuugccuggaugacgcggaagacugacgauuccauccgcccuuggaauuucgaagaccugguugacaaagagaagucagcagaggccuucauucauagaaugacaaacaaugauuuuuaccuuccagaagagaaaguguugccgaagcacagucugauauaugaaaaguucaccgucuacaacgagcucacuaaagugagguacaagaaugaacaaggcgagacauacuuuuucgacagcaacaucaaacaggagauuuuugaugguguguucaaggaacaucguaaagucuccaagaagaaacugcuugacuuucuggcuaaggaguaugaagaguuccggaucguugaugugauuggguuggacaaagaaaauaaggcguuuaacgcaucucucggaaccuaucacgaucuggagaaaaucuuagacaaggauuuccuggacaaucccgauaacgagagcauacuagaagacaucguacagacgcucacccuguuugaggaucgagaaaugauuaagaaaagacuugagaauuacaaggacuuguucacagaaucacagcugaaaaagcucuauaggcgccacuacacuggcuggggccggcugagugccaaauuaaucaacgggauuagagacaaggagucccaaaagaccauccuggauuaucuuauagacgauggaaggagcaaucgcaacuuuaugcaguugauuaacgacgauggucucucuuucaaaucaaucauuaguaaggcucaggccggcagccauuccgacaaucugaaagagguggucggggaacuagcaggaucuccugccaucaagaaaggcauacugcagucgcucaagaucguggaugagcugguuaaagugauggguuacgaaccagagcaaauugucguggagauggcucgagaaaaccagacaacuaaucaggggcggcguaacagcagacagagguacaaacuuuuggacgauggcguaaagaaucuggccuccgacuuaaacggaaauauccucaaggaguaucccaccgauaaccaagcacugcagaaugaacgccuuuuccuguacuauuugcagaacggccgggacauguacacaggggaggcgcucgacauugaugaccugucacaauaugauaucgaccacauaauuccucaggcuuuuaucaaggaugacaguaucgauaauagaguucuagugucuagcgccaaaaacaggggaaaguccgacgaugucccaucacuggaaauugugaaagacugcaaggucuucuggaagaaacuccuggaugcaaaacuuaugagccagcgaaaguacgacaauuugaccaaggccgagcgcgguggccugacuucugaugacaaagcucgguuuauccagagacaauuaguggagacgaggcagauuacaaagcauguugcccguauacucgacgaacgcuucaacaaugagcuggauuccaaggggcggagaaucaggaaagugaagauuguaacccuuaaaaguaaccuggucagcaacuuucgaaaggaguucggauuuuauaaaauccgggaagugaauaacuaccaccaugcacacgacgcuuaccuaaaugccguuguggcgaaggccauucucacuaaguauccccagcuggaaccggaguucgucuacggcgauuauccuaaauacaacucuuauaagacccgcaaauccgcuacagagaaguuguuuuucuacucaaauaucaugaacuuuuucaaaaccaaggugacucuggcagacgguacaguagugguuaaggaugacauagaagucaauaacgauacgggggagaucgugugggacaaaaagaaacacuucgccaccgugagaaaggucuuaaguuauccccagaauaacauuguuaaaaagacugaaauccaaacaggcggauuuagcaaagagucgauucucgcucauggcaauuccgauaagcugaucccaaggaagaccaaagacauauaccuugauccuaagaaauacgggggauucgacucucccauuguggccuauagcgugcugguagucgcagauaucaagaaagguaaggcgcagaaguugaaaacagugacugaacuccugggcaucaccauuauggagcggucacgauuugagaagaacccaagugccuuccuagaauccaaaggguaccugaauauaagagcugacaaacuuaucauucuccccaaguauucucuguuugaguuggaaaacggacgcaggcgucuguuagccagcgcaggcgagcuccagaaggguaaugagcuggcccuuccuacgcaguucaugaaguuucuguacuuggcuucccgguauaacgaaucaaaagggaagccagaggaaaucgagaaaaagcaagaguucguuaaccagcacgugagcuacuuugacgauauucuccagcugaucaaugacuucaguaaaagagucauacuagcagaugccaaccuggaaaagaucaauaaacuuuaucaagacaacaaggagaauauuucuguggaugaacucgcuaacaauaucauuaaccuguuuaccuucacauccuugggcgcgccggccgcauuuaaguucuucgacaaaaucguugauaggaagcgcuacacuagcaccaaagagguguuaaauucgacacugauacaucagucaauuacuggacucuacgaaacccgaaucgaccugggcaaacuuggggaggauuga

SEQ ID NO: 3140 - RNA, 4113 nt, Artificial Sequence
  Cas9 variant
augaacaagcccuacagcaucggccuggacauugggaccaauuccgugggauggucuauaaucacagaugacuauaaagucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauaggauucuguaccuacaggaaaucuuugcugaggaaaugucaaaaguggacgauaguuucuuucacagacucgaggacagcuuccugguagaagaggauaagcggggcuccaaauauccaauauuugccacucuucaagaggaaaaggacuaccaugagaaauucucuaccaucuaucaucugcgcaaggaauuggcagauaagaaagagcgagccgaccucagacugauuuacaucgcucuggcacacauuaucaaguuuaggggucacuuccucauagaggaugacucguuugacgugcggaacacagauauuucaaaacaguaccaggacuucuuagaaaucuuuaauaccacuuucgagaacaaugaucugcuuagccagaacgucgacguggaagccauuuugacagauaagaucaguaaauccgcuaagaaagaccguauccuggcccaauauccgaaucagaagucuaccgggauuuuugcggaguuccuaaagcucauaguuggaaaccaggcagauuucaaaaaguacuuuaaucuggaagacaaaacgccccuucaguucgccaaggauagcuaugacgaggaucuggagaacuugcucggccaaaucggcgacgaauuugcugaccuguucuccgccgcuaaaaaguuauacgauucagugcugcucagugggauucuuacugucaucgaccugagcaccaaggcuccuuugucugccuccaugauacagcgcuaugaugagcauagagaagaccuaaaacagcugaagcaguuugugaaagcgucacucccagagaaguaccaagaaauuuucgccgauagcaguaaagacggauaugcagguuacaucgagggcaagacaaaucaggaggcuuuuuacaaguaucugucuaaacuucugacuaagcaggaagauuccgagaacuucuuggaaaagaucaagaacgaggacuuucucaggaaacaacggaccuucgauaaugggagcauuccccaccagguacaccugacagaauuaaaggccaucauucgacgccagucggaguacuauccuuuucugaaggagaaccaggacagaauagagaaaauccuaaccuucaggauuccauacuauaucggaccccucgcucgggaaaagucugauuuugccuggaugacgcgcaaaacugacgauuccaucagaccuuggaauuucgaagaccugguugacaaggagaaaucagcagaggccuucauucauaggaugacaaacaaugauuuuuaccuuccagaagagaagguguugccgaaacacagucugauauaugaaaaguucaccgucuacaacgagcucacuaaggugcguuacaaaaaugaacaaggcgagacauauuucuucgacagcaacaucaagcaggagauuuuugaugguguguucaaagaacaucggaaggucuccaaaaagaagcugcuugacuuucuggcuaaagaguacgaagaguuccgaaucguugaugugauuggguuggacaaggaaaauaaagcguuuaacgcaucucucggaaccuaucacgaucuggagaagaucuuagacaaagauuuccuggacaaucccgauaacgagagcauacuagaagacaucguacagacgcucacccuguuugaggauagagaaaugauuaagaagaggcuugagaauuacaaagacuuguucacagaaucacagcugaagaaacucuaucgccggcacuacacuggcuggggcagacugagugccaaguuaaucaacgggauuagggacaaagagucccaaaagaccauccuggauuaucuuauagacgauggacgcagcaaucgaaacuuuaugcaguugauuaacgacgauggucucucuuucaagucaaucauuaguaaagcucaggccggcagccauuccgacaaucugaaggagguggucggggaacuagcaggaucuccugccaucaaaaagggcauacugcagucgcucaaaaucguggaugagcugguuaaggugauggguuacgaaccagagcaaauugucguggagauggcucgggaaaaccagacaacuaaucaggggcguagaaacagcaggcagcgcuacaaacuuuuggacgauggcguaaagaaucuggccuccgacuuaaacggaaauauccucaaggaguaucccaccgauaaccaagcacugcagaaugaacggcuuuuccuguacuauuugcagaacggcagagacauguacacaggggaggcgcucgacauugaugaccugucacaauaugauaucgaccacauaauuccucaggcuuuuaucaaagaugacaguaucgauaauaggguucuagugucuagcgccaagaaccgaggaaaauccgacgaugucccaucacuggaaauugugaaggacugcaaagucuucuggaagaagcuccuggaugcaaaacuuaugagccagcgcaaguacgacaauuugaccaaagccgagcgggguggccugacuucugaugacaaggcuagauuuauccagaggcaauuaguggagacgcgucagauuacaaaacauguugcccgcauacucgacgaacgguucaacaaugagcuggauuccaaggggagaaggauccgaaaggugaaaauuguaacccuuaagaguaaccuggucagcaacuuucggaaagaguucggauuuuauaagauccgcgaagugaauaacuaccaccaugcacacgacgcuuaccuaaaugccguuguggcgaaagccauucucacuaaguauccccagcuggaaccggaguucgucuacggcgauuauccuaaguacaacucuuauaaaaccagaaaguccgcuacagagaaauuguuuuucuacucaaauaucaugaacuuuuucaagaccaaagugacucuggcagacgguacaguagugguuaaggaugacauagaagucaauaacgauacgggggagaucgugugggacaagaaaaagcacuucgccaccgugaggaaagucuuaaguuauccccagaauaacauuguuaagaaaacugaaauccaaacaggcggauuuagcaaggagucgauucucgcucauggcaauuccgauaaacugaucccacggaagaccaaggacauauaccuugauccuaaaaaguacgggggauucgacucucccauuguggccuauagcgugcugguagucgcagauaucaaaaaggguaaagcgcagaaguugaagacagugacugaacuccugggcaucaccauuauggagcgaucaagauuugagaaaaacccaagugccuuccuagaauccaagggguaccugaauauacgcgcugacaaacuuaucauucuccccaaguauucucuguuugaguuggaaaacggaaggcgucggcuguuagccagcgcaggcgagcuccagaaagguaaugagcuggcacuuccuacgcaguucaugaaguuucuguacuuggccuccagauauaacgaaucaaaggggaaaccagaggaaaucgagaagaaacaagaauuuguuaaccagcacgugagcuacuuugacgauauucuccagcugaucaaugacuucaguaagagggucauacuagcagaugccaaccuggagaaaaucaauaaacuuuaucaagacaacaaggagaauauuucuguggaugaacucgcuaacaauaucauuaaccuguuuaccuucacauccuugggcgcgccggccgcauuuaaauucuucgacaagaucguugaucgcaaacgauacacuagcaccaaggagguguuaaauucgacacugauacaucagucaauuacuggacucuacgaaaccagaaucgaccugggcaaacuuggggaggauuga

SEQ ID NO: 3141 - RNA, 4113 nt, Artificial Sequence
  Cas9 variant
augaacaagcccuacagcaucggccuggacauugggaccaauuccgugggauggucuauaaucacagaugacuauaaagucccugccaagaaaaugagaguucucgguaacacugauaaggaguacauuaaaaagaaucuuaucggcgcucuguuguucgacgggggaaacacggcaucagauaggcgguuaaagcgcaccgcccgacguagauauacaaggcggcgcaauaggauucuguaccuacaggaaaucuuugcggaggaaaugaguaaaguggacgauagcuucuuucacagacucgaggacuccuuccugguagaagaugacaagcggggcucuaaauauccaauauuugcuacuaugcaagaggagaaggauuaccaugaaaaauucccgaccaucuaucaccuucgcaaggagcuggccgacaagaaagaaaaggcagauuugcgacucuuuuaccuggcccuggcucauauuaucaaauucagaggucacuuucucauugaggacgacucguucgaugugaggaacacagacauccagcggcaguaccaggcauuuuuagagauauucgauaccacuuuugaaaauaaccaucugcuuucacaaaauauugacgucgaggggaucuugacagauaagauuagcaaaagugccaagaaagaccguauccuggcucaguaucccaaccagaaguccaccggaaucuucgccgaguuccuaaagcucauugugggcaaucaggcggauuuuaaaaagcacuucaaccuggaagacaaaacgccucuucaauuugcaaaggauucuuacgacgaagaucuggagaauuugcucggccagauaggggacgaguucgccgaccuguuuagcguugcuaaaaaguuauaugauuccgugcugcucucaggaauccuuacugucaccgaccugaguacaaaggccccauugagcgcaucuaugauucagcgcuacgaugaacacagagaggaccuaaaacagcugaagcaauucgugaaagcuagccuccccgaaaaguaucaggagaucuuuacugauucaagcaaagacgguuacgccggcuauauagaagggaagaccaaccagggagcguucuacaaguaccugaguaaacuucugacaaagcaagagggcucugaguauuuucuugaaaagauuaagaaugaggauuuccucaggaaacagcggaccuuugacaacgguuccaucccucaucagguacaccugacggaauuaaaggccaucauucgacgccagagcgaguacuauccauuccugaaggaaaaccuagauagaaucgagaaaauucucacuuuuaggauacccuacuauguugggccucuggcacgggagaagucggacuucgcuuggaugacacgcaaaaccgaugacucuaucagaccauggaauuucgaggaacuuguggauaaggaagccuccgcugaggccuuuauucauaggaugacuaacaaugacuuguaccugccggaggaaaaaguccuccccaagcacucacugaucuaugagaaauucacaguguacaacgaacuuaccaaggugcguuacaagaaugagcaaggagaaacguacuuuuucgacaguaacaucaaacaggagauuuuugauggcgucuucaaggagcaccggaaaguuagcaagaaaaagcuguuggacuuucucgcaaaggaauaugaggaguuccgaauaguggauguaaucggccuggacaaagaaaauaaggccuuuaacgcuuccuuagggaccuaucaugaucugaaaaagauucuagacaaagauuuccucgacaauccugauaacgaaucuauccuggaggacauugugcagacacuuacuuuguuugaggauagagaaaugaucaagaagaggcuggagaauuacaaagaccucuucaccgaaagccagcugaagaaauuauaucgccggcacuacacaggaugggguagacugucagcgaaacuuauaaacggcaucagggauaaagagagucaaaagacuauuuuggacuaucucaucgacgaugggaaguccaaucgcaacuuuaugcagcugauucaugacgauggacuauccuucaaaucuaucauaucaaaggcacaggccggcagucacagcgacaaucugaaagaagucgugggugagcucgcuggguccccagccauuaagaaaggcauccugcagucucuuaagauuguugaugaguuggugaaagucaugggauacgaacccgagcaaaucgugguagaaauggcacgagagaaccagaccacaaaccagggccggcguaauucgagacagagguacaagcuguuagacgaugggguuaagaaccucgccagcgaccugaauggaaacauacuuaaagaguauccuaccgauaaucaagcucugcagaacgaacgcuuguuccucuacuaucugcagaauggucgggacauguacacuggcaaggcccuagauaucgacaaccugucccaauaugacauugaucauaucauuccacaggcauuuaucaaagacgauucaauagacaauagagugcucgucaguucugcgaagaacagggggaaaagcgaugacgugcccucccuggagauugucaaggauugcaagguguucuggaaaaaguuguuggacgcuaaacugaugucacagcgaaaguacgauaauuuaacgaaagccgaacgcggaggccucacaagcgacgauaaggcacgguuuauccagagacaacugguugagaccaggcagaucacuaagcacguggcccguauucuugacgaacgcuucaacaaugagcuggauucuaaaggucggagaaucaggaagguaaaaauugucacccuaaaguccaaccucgugaguaauuuucgaaaagaguucggguuuuauaagauacgggaaguuaacaacuaccaccaugcucacgacgccuaccugaaugcaguggucgcuaaggccaucuugacaaaauauccgcagcuggagccugaguucguguacggcgacuaucccaaguacaacagcuauaaaacccgcaagucugcgacugaaaaauuauuuuucuacuccaauauuaugaacuuuuucaagacaaagguaacgcucgccgauggaaccgugguugucaaagacgauaucgaagugaauaacgacacuggcgagauugugugggauaagaaaaagcauuucgcuacagucagaaaaguucugucauauccacaggugaauaucgugaagaaaaccgagauacaaacagggggauuuaguaaggaaagcauccuugcacacgguaacucggacaagcugauuccuaggaaaacuaaggauaucuacuuggaccccaaaaaguacggcggguucgauuccccaauuguagccuauucuguccucgugguugcugacaucaaaaagggaaaggcccagaaacugaagaccgugacggagcuacugggcauaaccauuauggaacggagccgauuugagaaaaaucccucagcauuccuugaaaguaaggguuaccucaacaucagagaugacaaacugaugaucuugccuaaguauucccuguuugaguuagagaaugggcgcaggcgucuccuggcgucugccggcgaacuucagaagggaaacgagcuggcuuugccaacacaguucaugaaauuucucuaccuggccagccgguauaaugaacuaaagggcaaaccggaggagauugaacaaaagcaggaguucgucgugcagcacguuuccuacuuugaugacauacugcaaaucauuaacgacuucucaaauagagugauccuugcagaugcuaaccucgagaaaauuaacaagcuguaucaggacaauaaggaaaacaucagcguagaugaauuggccaauaacauaaucaauuuauuuacuuucaccagucugggggcacccgccgcuuuuaaauucuucgacaagauugucgauaggaaacgcuacacaucuacuaaggaggugcucaacuccacccugauccaucagagcauuacgggacuuuacgagacacgaaucgaccugggcaaauugggugaagauuga

SEQ ID NO: 3142 - RNA, 4113 nt, Artificial Sequence
  Cas9 variant
augaacaagcccuacagcaucggccuggacauugggaccaauuccgugggauggucuauaaucacagaugacuauaaagucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauaggauucuguaccuacaggaaaucuuugcugaggaaaugucaaaaguggacgauaguuucuuucacagacucgaggacagcuuccugguagaagaggauaagcggggcuccaaauauccaauauuugccacuaugcaagaggaaaaguacuaucaugagaaauucccgaccaucuaccaccuucgcaaggaacuggcagacaagaaagagaaggccgauuugcgacucauuuaccuggcucuggcacauaucauuaaauuuagaggucacuuccucaucgaggacgauagguuugacgugcggaacacagacauacagaagcaguaucaggccuucuuagaaauuuuugauaccacuuucgagaauaacgaccugcuuucucaaaaugucgauguggaagcuaucuugacagacaaaauuucgaagucagccaaaaaggaucguauccuggcgcgcuaccccaaccaaaagagcaccgggaucuuugcagaguuccuaaaacucauuguuggaaaucaggccgacuucaagaaacauuuuaaccuggaagauaagacgccucuucaguucgcuaaagacaguuaugaugaggaccuggagaauuugcucggccagauaggcgaugaauuugccgaccuguucuccgcagcuaagaaguuauacgacucugugcugcucagcgggauccuuacugucaccgaucuguccacaaaagccccauugucagcgaguaugauucagcacuaugacgagcacagagaagaucuaaagcagcugaaacaguuugugaaggccagccuccccgagaaauaccaagaaaucuucgcagacucuuccaaggauggauaugcugguuacauagagggcaagacuaaccaggaggccuuuuacaaauaucugucaaaacuucugaccaaacaggaagggagcgaguacuugcucgaaaagauuaaaaaugaggacuuccugaggaagcaacggacauuugauaacggaaguaucccucaucagguacacuuaaccgaacugcgagcuaucauucgcagacagucugaguauuacccauuccuaaaggagaaccucgacaggaucgaaaagauucugacguuucggauacccuauuacguuggcccucuugcccgcgagaaguccgauuucgcauggaugacuagaaaaacagacgauagcaucaggccauggaauuuugaagacuugguggauaaggagaaaucggccgaggcuuucauucaucguaugaccaacaaugaccuguaucucccggaagagaagguccugcccaaacacucucuuaucuacgaaaaguucacuguguacaacgagcugacaaaggugcgguuuuuggcggaagguuucaaagacuuucaguuccucaaucgaaagcaaaaagagaccaucuuuaacucccuguucaaggagaaaagaaaggucacggaaaaggauauuauaucauuuuuaaauaaaguugacggguaugagggaaucgcaauuaagggcaucgaaaaacaguucaacgccagucugagcaccuaccacgaucuaaagaaaauucucggcaaggacuuucuggauaauacagacaacgagcuuaucuuggaagauauagugcagacucugacccucuucgaggacagggagaugauccgcaagcggcuggauauuuauaaagacuuuuucacagaaucccaguuaaagaaacuguacagaaggcauuauacuggguggggacgccuuucugcuaaguugaucaaugguauucgaaacaaagagaaucaaaagaccauccucgauuaccugauagacgauggcagcgccaaccggaauuuuaugcagcuaauuaaggacgcagggcugucauucaaaccuaucauugacaaggcccguacaggaagucacuccgauaaccucaaagaaguagugggcgagcuggcugguagcccagccaucaagaaagggauacuucagucuuugaagaucgucgacgaacuggugaaaguuaugggcuaugagcccgagcagauuguggucgaaauggcaagagagaaccaaaccacugcgaagggauuaucaaggagucgccagcggcucacgacacugagagaaagccuugcuaaucugaaguccaacaucuuggaggagaaaaagccuaaauacgugaaggaucagguagaaaaucaucaccucucugacgauaggcuguuccuauacuaucugcagaacggcaaagacauguacaccgaugacgagcucgauauugacaaucugucgcaauaugauaucgaccauauaauuccacaggccuuuaucaaggacgauagcaucgacaaccgaguucuuguguccucagcaaagaaucgcgggaaaagugaugacguccccucuguggaaauugucaaggauugcaaaguguucuggaagaaauugcuggacgccaaguuaaugagccagcggaaguacgauaaccucacuaaagcugagagaggaggucugaccuccgacgauaaggccagguuuauccaacgucagcuuguugaaacacgccagauuaccaaacacguggcacggauacuggacgagagauucaauaacgagcuagauucaaagggcaggcgaauccggaaaguaaagauugucacucucaagagcaaucuggugucuaacuuucgcaaagaguucggguuuuauaagaucagagaaguuaauaacuaccaccaugcucacgacgccuauuugaaugcgguggucgccaaagcuauucugacaaaguacccgcaguuagaaccugaguucguguacggagauuaucccaaauacaacuccuauaagacgaggaagagugcaaccgaaaaacucuuuuucuacagcaacaucaugaauuucuucaagacuaaaguaacacuggccgacggcaccgugguugucaaggacgauauagaggugaacaaugacacaggugagaucgugugggauaaaaagaaacauuucgcuacuguccggaagguucuuucuuauccacaagugaacauugugaagaaaaccgaaauccagaccgggggcuuuuccaaggagucaauucuggcccacggaaauagugacaaauugaucccucgaaagacgaaagauauauaccucgaccccaagaaguauggcggguucgauagcccaauuguagcauacucgguccuggugguugcggacaucaaaaagggaaaagcccagaagcuaaaaacagugacugaacugcuugguaucaccauuauggagagaucccgcuuugaaaagaaccccucugcuuuccucgagagcaagggcuaccugaauauaagggaugacaaauugaugauccugccuaaguauucauuauuugagcucgaaaacgggcgucggagacugcuugccagugcaggagagcugcagaaaggcaaugaauuggcucucccaacacaauucaugaaguuucuguaccuagccuccagguauaacgagcugaaagguaagccggaggaaauugagcagaagcaggaauuugucgugcagcacguuucuuacuuugaugacauccuucaaauuaucaaugauuucagcaaccgcgugauacucgcagacgccaaucuggagaaaaucaacaaguuguaucaggacaauaaagaaaacauucccguagaugaguuagcuaacaauaucauuaaccuguuuacuuucaccucccucggggcgccugccgcauuuaaguucuucgacaaaaucgucgaucgaaagagauacacgucaacaaaagaggugcugaauagcacccuuauacaucagaguauuacuggccuguaugaaacacggaucgacuugggaaagcuaggcgaggauuga

SEQ ID NO: 3143 - RNA, 4116 nt, Artificial Sequence
  Cas9 variant
augaaggugaacaauuaccacaucggccuggacauugggaccagcuccauaggaugggucgccaucggugaggauggcaaaccccucagaauuaaggggaaaacagcuaucggagcaaggcuuuuccaggaaggcaacccugccgcggaccggcgcauguuucgaacuacgcguagaaggcugucucggcgcaaguggagauugaaauuacuggaggaaauuuucgauccauauaucaccccgguugacucaacauuuuucgcuaggcuaaagcaaaguaaucucagccccaaggauucccggaaagaguuuaaggguucuaugcuguucccugaccuuacugauaugcaguaccauaaagacuauccaaccauauaccaucugcgccacgccuugaugacacaggaugaaaaguuugacauccgaaugguguaucucgcaauucaccauaucguaaaauacagagggaacuuccuaaauucgacccccguggauucauuuaaggccagcaaggucaacuucguggaccaguuuaaaaagcugaaugagcucuauacugcuauuaacccugaggaaaguuuccaaaucaauuuagcaaacuccgaggauauaggacaccaguuucuggacccaucuauuaggaaauucgacaagaaaaagcagauccccaaaauuguuccugugagcgucgaugacaaggccacagauaagaucaauggcaaaaucgcuuccgaaauuauaaacgccauccuuggcuacaagucaaaauuggacgugguaguucagugcaccccaguggauaguaagagcugggcgcugaaauucgacgaggaggauauugacgcaaagcuacaaaagauccucccggaaauggaugagaaucagcagucuauaauugccauccugcagaaccuuuacucccaagucacgcugaaucagaucgugcccaacgggaugucauugagcgaaaguaugauugagaaauauaacgaccaccaugaucaccucaagcuguacaaaaagaucauugaccaguuagcugacccuaaaaagaaggccgcacugaaaaaggcuuauucucaauacgugggagaugacgguaaagucauagaacaggccgauuuuugguccagcguuaagaaaaaucucgacgauucggaccuuucuaagcagaucauggaucugauugacgcggagaaguucaugccaaaacagcggacuucccaaaacggcgugaucccccaucaguugcaccagcgugagcuagaugaaaucauugagcaccagucaaaguauuacccuuggcuggccgaaauaaauccaaacaaacaugaccuccaccuggcaaaguauaaaaucgaggaacuuguagcuuuucgcgugcccuacuacgucgggccgaugauuaccccugaugaccaagccaagagugcugagacaguguucagcuggauggagagaaaaggaaaggaagccggccagaucacucccuggaauuuugaugagaagguugacaggaacgcauccgccaaucgguucauuaaacgaaugaccacaaaggacaccuaucugaucggugaagauguguugccagacgagucucuccuguacgaaaaauuuaaggucuuaaacgagcugaauauggugcgcguaaacgggaaacuacucaagguugcugauaagcaggcgauauuccaggaccuguuugagaauuauaaacauaucagcgugaagaaacuucaaaacuacauuaagucaaaaacgggauugccuagugaucccgaaaucuccggccugagcgacccagaguauuucaauaacucucucggcacuuacaaugauuuuaagaagcuguucgggaacaaagucgacgaacccgaucuucaggacgauuuugagaagauuguggaguggucaacagucuucgaagacaaaagaauccugagggagaaguugaacgaaauaaccuggcucagugaucagcagaaagacgugcuggagagcucccgguaucaaggauggggucgcuuaucuaagaagcugcuaacuggcauuguuaaugaccagggggaaagaaucauugaugagcucuggaacacaaauaaaaacuucaugcagauccaaucggacaaugauuuugcaaagaggauacacgaggccaacgcugaccagaugaaagccguggauguagaagacguccuggcagaugccuacaccagcccucagaauaagaaagcuauccgucaggugguuaagguggucgacgauauucaaaaagccaugggaggcguggcaccaaaguacaucuccauugaguucacgcggucagaagaccgaaacccgagaaggaccaucagucgccagcggcagcuugagaauacauugaaggauacugcgaaaucucuggcuaagagcauaaaccccgaacuccuguccgaguuagacaaugccgcaaaaucaaagaaaggucugaccgacagacuuuauuuguacuuuacacagcucgggaaggauauuuauacuggcaagccuaucaacaucgacgagauuagcaccuacgauaucgaccauauucugccacaagccuucguaaaagaugacucucuaaauaacagggugcugguuuccaaggcuauaaauaacggaaaaagugauaacguccccgugcagcucuuuggcgccaagauggggcacuucuggaaacagcuggcagaagcuggacuuaucagcaagcgcaaguugaaaaaucugcagacagacccugauaccauuucuaaguaugccaugcacgguuuuauccgacggcaauuaguggagacuucccaggucauuaaacucguugcgaacauccugggcgacaaguaccguaaugauaacacgaaaauaaucgaaauuacagccagaaugaaucaucagaugagggacgaguucggguuuaucaagaaccgcgaaauuaaugauuaucaccaugcuuucgacgcauaccuuaccgccuuucugggacgguacuuguaucacagauacaucaagcucaggccauauuucguguacggcgacuuuaaaaaguucaaagaggauaaggugacuaugcgaaacuucaauuuucugcacgaccuaaccgaugacacacaagagaaaauagcugaugccgaaaccggugagguaauuugggaccgcgaaaacucaauccagcagcugaaggaugucuaucauuacaaguucaugcucaucagucacgagguguauacucugagaggggcaauguuuaaucagacaguuuaccccgcgagcgacgccggcaaacggaaacuuauuccgauaaaagcugauaggccuaucaacguguacggaggcuauucgggguccgccgacgcauacauggcuauuguccguauccauaauaagaaaggagauaaguaucgcgugguuggugugccaaugcgggccagagacagguuggaugcagccaaaaagguaucugacgcugacugugaucgagcgcugaaggacgucuuaacgccccaacucaccaaaacuaagaaaagccggaagacaggcgagauuacccaggugguggaagauuucgagaucguccuggggaaaguuauguaccgccagcuuaugauagacggagauaagaaguuuaugcugggcucaaguacauaucaguacaacgccaaacaacuggugcucuccgaccagucuguaaagacucuggcaagcaaagguagauuggauccucugcaggaauccauggacuauaauaacguguacaccgagaucuuagauaaggucaaccaguacuucucacucuaugacaugaauaaauuuaggcacaagcugaaccuuggguucagcaaguuuauuaguuuccccaaucauaacguguuugauggcaauacgaaggcuucuuccggaaagcgggaaauccuggaggagguuuugaacggccuccacgccaauccaaccuucgggaaccugaaagacauuggaaucacaacuccuuucggccaacuacagcagcccaaugguauacugcuuagcgacgaagccaagauucgauaccagucgccaaccgggcucuuugagagaacagugucacugaaagauuuguga

SEQ ID NO: 3144 - RNA, 4116 nt, Artificial Sequence
  Cas9 variant
auggacaagaaauacagcaucggccuggauauugggaccaacuccgugggaugggccgucauaacagacgauuauaagguucccucuaaaaaguucaaagugcucgguaauacugacagacacucaaucaagaagaaccuuauuggcgcucuguuguuugauaguggggagacggcagaagccaccagguuaaaacggacagcgcgccgacguuacacuagaaggaagaaucggauccgcuaucugcaggagauuuucagcuccgaaaugucuaaaguagacgauucguuuuuccauagacuagaggaaucauuucucguggaggaggacaagaaacacgaaaggcauccuaucuucggaaacauagucgaugagguggcuuaccacgaaaaguauccaaccaucuaccaucugcggaagaaacuugccgacagcacagauaaggcagaccugcgcuugauuuaucucgcccuggcucacaugaucaaauuucgaggccacuuccugauugagggugaucucaauccggacaacagugacauggauaaguuauuuauccaacugguucagaccuacaaucagcuuuucgaggaaaaccccauaaaugcauccagaguggacgccaaagcuauuuugucugccaggcugagcaagucccggcgucuagagaaccucaucgcgcagcugccuggggaaaaacgcaauggacuuuuuggcaaccugauugcauugucacucggccugacuccaaauuucaagaguaacuuugauuuagccgaggacgcuaagcugcaacucagcaaagauacauacgacgaugaccuugauaaucuguuggcccagaucggggaccaguaugcagaucuauuccuggcugccaagaaccucucugacgcgauccugcuuuccgacauucugagagucaacucagaaauaaccaaagcccccuugagcgcaaguaugaucaagagguacgaugagcaucaccaggaccucacgcuguuaaaagcucuggugcggcaacagcuaccugagaaguauaaggaaauuuucuuugaucagucuaaaaauggauacgccgguuauaucgacggcggggcuucccaggaggaguucuacaaguuuauaaaaccaauucucgagaagauggauggaacugaagaacugcuugccaaauugaaccgagaggaccugcuccgcaagcaaagaaccuucgauaauggcagcaucccccaucagauccaccugggugaacuucacgcaauucugaggcggcaggaggacuuuuauccuuucuugaaggauaaccgcgaaaagaucgagaagauucucacauuuagaauaccauacuacguagggccgcuggccaggggaaauucgcguuucgcuuggaugacucggaaaucugaagagaccaucacacccuggaacuuugaggaaguuguggacaagggcgcguccgcacaaucauucauugagcgaaugaccaauuuugauaaaaacuuaccuaaugaaaagguccugccaaagcauagucuacucuaugaguacuucacgguguauaacgagcugacuaaagugaaguacgucacagaaggcaugagaaaacccgaguuucuuagcgggaagcagaaagaagccaucguugacuugcuguucaagaccaauaggaaagugacuguaaagcagcucaaggaggauuauuucaaaaagaucgaaugcuuugacuccguggagauuucuggagucgaggaccgcuucaacgcuagccuggguacauaccacgauuuacugaaaauaaucaaggacaaagauuuucuugacaaugaagagaacgaagauauuuuggaggacaucgugcucacccugacgcuauucgaagauaaggagaugauugaggaacggcugaagaaauaugccaaucucuuugacgauaagguuaugaaacagcugaagagaaggcauuacaccggcugggggcgccuuucacgaaaauugaucaacggaauacgggacaagcaaaguggcaagacaauccuggauuucuuaaaauccgacgguuuugcaaaccguaauuucaugcagcucauuaacgaugacagccugacuuuuaaggaggccauccagaaagcucaggugucugggcaaggccacucacuucaugaacagauugccaaucuggcaggaaguccugcgaucaagaaaggcauauugcagagcgucaaggugguagacgagcucguuaaggugauggggcacaaaccagaaaacauugucaucgagauggcuagagagaaucagaccacacaaaagggacagaaaaacuccagggaacgcaugaagcggauugaggaagguaucaaagagcugggcucucagauacuaaaggagcaccccguggaaaauacucagcugcaaaacgagaaacucuaccuguauuaccuucagaaugggagagauauguaugucgaccaggaauuggauaucaacaggcugucggacuacgauguggaccauauuguuccgcagagcuucaucaaggaugacuccauugauaauaagguguuaacccgaucagacaaaaaccgcggaaagagugauaauguaccuucugaggaagucgugaaaaagaugaaaaacuauuggcggcaacuccugaaugccaaacuuaucacacagagaaaguuugacaaccugaccaaagcagagaggggcggucuaagcgagcucgacaaggccggguucauaaaacgucagcugguugaaacucgccaaauuacgaagcacguggcucagaucuuggauucccggaugaacacaaaauacgacgagaaugauaagcugaucagagaagucaaggugauuaccuuaaaaucaaagcucguaagcgacuuuaggaaagauuuccaguucuauaaggugcgagagaucaacaauuaccaucacgcccacgacgcauaccugaacgcuguugucggcacugcccuuauuaaaaaguaucccaagcuggaaucugaguuuguguacggagauuauaaaguguacgacguccggaagaugauagcgaaauccgagcaggaaaucggcaaggccaccgcuaaacgcuucuuuuauaguaauauuaugaacuucuuuaagacagagaucaccuuggcaaauggggaaauuagaaagaggccacucaucgagacuaacgaagagacaggagagauaguuugggauaaaggucgggacuucgccacggugcgaaaggugcugagcaugccucaaguaaauaucgucaaaaagaccgaagugcagacuggcgcucuaacaaacgagucuauuuacgccagaggguccuuugauaaacugaucucacgcaagcauagguucgaaaguagcaaauauggaggcuuugguucgcccaccguuacauacuccgugcuugucguggcaaagucuaagguucaggacgggaaagugaagaaaauuaagacuggcaaagagcucaucggaauaacccuguuggauaagcugguauucgagaagaauccauuaaaauuuauugaagacaagggcuacgggaacguccagaucgacaaauguaucaagcuccccaaauauagccuguucgaguucgaaaauggaacgcgucggaugcuugcgucagugauggccaacaauaacaguagaggcgaucugcaaaaggcuaacgagauguuuuugccugccaagcucgugacccugcuauaccacgcacauaaaauugaauccucuaaggagcuggagcacgaggcuuauauacuugaccauuacaaugaucucuaucagcuguugagcuacaucgaaagguucgccuccuuauaugucgacguugagaaaaacauuucaaaggugaaagaacuguuuagcaauaucgaaaguuacucuauuuccgagaucugcagcucgguaauaaaccuccugacacuuacugcaucaggugccccagcugauuucaaguuucuggggaccacaaucccgcgcaagcgauacggaucuccccagaguauuuuguccagcacucuaauccaccaaucuauuaccggccuguaugagacgagaaucgaccucagccagcuggguggcgauuga

SEQ ID NO: 3145 - RNA, 4116 nt, Artificial Sequence
  Cas9 variant
auggacaagaaauacagcaucggccuggauauugggaccaacuccgugggaugggccgucauaacagacgauuauaagguucccucuaaaaaguucaaagugcucgguaauacugacagacacucaaucaagaagaaccuuauuggcgcucuguuguuugauaguggggagacggcagaagccaccagguuaaaacggacagcgcgccgacguuacacuagaaggaagaaucggauccgcuaucugcaggagauuuucagcuccgaaaugucuaaaguagacgauucguuuuuccauagacuagaggaaucauuucucguggaggaggacaagaaacacgaaaggcauccuaucuucggaaacauagucgaugagguggcuuaccacgaaaaguauccaaccaucuaccaucugcggaagaaacuugccgacagcacagauaaggcagaccugcgcuugauuuaucucgcccuggcucacaugaucaaauuucgaggccacuuccugauugagggugaucucaauccggacaacagugacauggauaaguuauuuauccaacugguucagaccuacaaucagcuuuucgaggaaaaccccauaaaugcauccagaguggacgccaaagcuauuuugucugccaggcugagcaagucccggcgucuagagaaccucaucgcgcagcugccuggggaaaaacgcaauggacuuuuuggcaaccugauugcauugucacucggccugacuccaaauuucaagaguaacuuugauuuagccgaggacgcuaagcugcaacucagcaaagauacauacgacgaugaccuugauaaucuguuggcccagaucggggaccaguaugcagaucuauuccuggcugccaagaaccucucugacgcgauccugcuuuccgacauucugagagucaacucagaaauaaccaaagcccccuugagcgcaaguaugaucaagagguacgaugagcaucaccaggaccucacgcuguuaaaagcucuggugcggcaacagcuaccugagaaguauaaggaaauuuucuuugaucagucuaaaaauggauacgccgguuauaucgacggcggggcuucccaggaggaguucuacaaguuuauaaaaccaauucucgagaagauggauggaacugaagaacugcuugccaaauugaaccgagaggaccugcuccgcaagcaaagaaccuucgauaauggcagcaucccccaucagauccaccugggugaacuucacgcaauucugaggcggcaggaggacuuuuauccuuucuugaaggauaaccgcgagaaaaucgaaaagauucucacauuuagaauaccauacuacguagggccgcuggccaggggaaauucgcguuucgcuuggaugacucggaaaucugaagagaccaucacacccuggaacuuugaggaaguuguggacaagggcgcguccgcacaaucauucauugagcgaaugaccaauuuugauaaaaacuuaccuaaugaaaagguccugccaaagcauagucuacucuaugaguacuucacgguguauaacgagcugacuaaagugaaguacgucacagaaggcaugagaaaacccgaguuucuuagcgggaagcagaaagaagccaucguugacuugcuguucaagaccaauaggaaagugacuguaaagcagcucaaggaggauuauuucaaaaagaucgaaugcuuugacuccguggagauuucuggagucgaggaccgcuucaacgcuagccuggguacauaccacgauuuacugaaaauaaucaaggacaaagauuuucuugacaaugaagagaacgaagauauuuuggaggacaucgugcucacccugacgcuauucgaagauaaggagaugauugaggaacggcugaagaccuaugcccaucucuuugacgauaaaguuaugaagcagcugaaaagaaggcacuacacaggcugggggcgccuuucacgaaaguugaucaauggaauacgggacaaacaaaguggcaagacuauccuggauuucuuaaaguccgacgguuuugcaaaccguaacuucauucagcucauccaugaugacagccugaccuuuaaagaggccauucagaaggcucaggugucugggcaaggccacucacuucacgaacagaucgccaaucuggcaggaaguccugcgauuaaaaagggcauauugcagagcgucaaagugguagacgagcucguuaaggugauggggcauaagccagaaaacaucgucauugagauggcuagagagaaucagacaacucaaaaaggacagaagaacuccagggaacgcaugaaacggaucgaggaagguauaaaggagcugggcucucagauccuaaaagagcaccccguggaaaauacccagcugcaaaacgagaagcucuaccuguauuaccuucagaaugggagagauauguaugucgaccaggaauuggauauuaacaggcugucggacuacgauguggaccauaucguuccgcagagcuucauuaaagaugacuccaucgauaauaagguguuaacacgaucagacaagaaccgcggaaaaagugaugacguaccuucugaggaagucgugaagaaaaugaagaauuauuggcggcaacuccugaacgccaaacuuauaacccagagaaaguuugacaaucugacuaaggcagagaggggcggucuaagcgagcucgauaaagccggguucauuaagcgucagcugguugaaacgcgccaaaucacaaaacacguggcucagaucuuggacucccggaugaacaccaaguacgaugagaaugacaaacugauuagagaagucaaggugaucacuuuaaagucaaaacucguaagcgauuuuaggaaggacuuccaguucuauaaagugcgagagauuaacaacuaccaccaugcccacgaugcauaccugaaugcuguugucggcaccgcccuuauaaagaaauaucccaagcuggaaucugaguuuguguacggagacuauaagguguacgauguccggaaaaugaucgcgaaguccgagcaggaaauuggcaaagccacagcuaagcgcuucuuuuauaguaacaucaugaauuucuuuaaaaccgagauuacuuuggcaaacggggaaaucagaaagaggccacucauagagacaaaugaagagacgggagagaucguuuggaacaagggucgggacuucgccaccgugcgaaaagugcugagcaugccucaaguaaauauugucaagaaaacugaagugcagacaggcgcucuaaccaacgagucuaucuacgccagaggguccuuugauaagcugauuucacgcaaacauagguucgaaaguagcaaguauggaggcuuugguucgcccacaguuacuuacuccgugcuugucguggcaaaaucuaagguucaggacgggaaggugaaaaagaucaaaaccggcaaggagcucauaggaauuacgcuguuggauaaacugguauucgagaagaauccauuaaaguuuaucgaagacaaaggcuacgggaacguccagaucgacaaguguauuaaacuccccaaguauagccuguucgaguucgaaaauggaacccgucggaugcuugcgucagugauggccaacaauaacaguagaggcgaucugcaaaaagcuaaugagauguuuuugccugccaagcucgugacacugcuauaccacgcacauaagauagaauccucuaaagagcuggagcacgaggcuuauauccuugaccacuacaacgaucucuaucagcuguugagcuacauugaaagguucgccuccuuauaugucgacguugaaaagaacaucucaaaagugaaggagcuguuuagcaauauugaaaguuacucuaucuccgagauaugcagcucgguaaucaaccuccugacucuuaccgcaucaggugccccagcugauuucaaauuucuggggacaacuauuccgcgcaagcgauacggaucuccccagaguaucuuguccagcacccuaauucaucaaucuaucacgggccuguaugagacaagaauagaccucagccagcuggguggcgauuga

SEQ ID NO: 3146 - RNA, 4116 nt, Artificial Sequence
  Cas9 variant
augaacaauaacaauuacagcaucggccuggacauugggaccaacuccgugggaugggccgucauaacagaugacuauaagguucccucuaaaaagaugagagugcucgguaauacugauaaaagguucaucaagaaaaaccuuauuggcgcucuguuguuugacgaggggacgaccgcagaagaucggcgcuuaaagcgaacagcccguagaagguacacucggcgcaagaauagacugagguaucuacaggagaucuucgcggaagagaugucaaaaguagacaguagcuuuuuccaccggcucgaugacuccuuucuggugccugaagauaagucuggaucgaaauacccaauuuucgcuacccuugccgaggagaaggaauaucauaaaaaguuuccgacaaucuaccaucugcgcaagcacuuggcagacucaaaagagaaggccgaucuccgacugauauaucuggcucucgcacacaucaccaaauacagaggccauuucuuauacgaagaggccuuugacauuaagaacaaugauauccagaaaauuuucaacgaguuuaucaauauauaugacaacacuuucgaagguagcagucuguccgggcaaaaugcucaggucgaggccauuuuuacaggaaagaucucuaaaagcgugaagagggaacacguucuuaaguuguuccccgacgagaaauccaccggccuguucucagaauuucuaaagcucauugugggcaaccaggcggauuucaaaaagcacuuugaccuggaggagaaagcaagucuucaauucagcaaggauacguacgacgaagaucuggagaauuugcucgggcagaucggagacgauuuugccgaccuguucuuagucgcuaagaaacuguaugaugccauccuccuuucugguauucugacugugaccgacccuuccacaaaggcaccauugucagcuagcaugauagaacgguacgagaaccaucaggaagaucuagccgcgcugaaacaguuuaucaagaacaaucuccccgagaaauaugccgagguauucagugaccaaucuaaggacggcuacgcaggguauauugauggaaagacuacccaggaagcguuuuacaaauacaucaagaaccugcuuuccaaauucgagggcgccgacuauuuucuggauaagauagaacgugaggacuucuugcgcaaacagagaacauuugauaaugguagcauuccucaccagauccaucuccaagaaaugaacgcuauccugaggcggcagggggagcacuacccauuacugaaggagaauaaggagaaaauugaaaagauccuaaccuucaggauucccuauuacguuggaccucucgcccgcggcaacagagacuucgcauggcugacgcgaaauucggaucaggccauacggccauggaacuuugaagagaucguggacaaggcuucuuccgcggagucauucauuaauaaaaugacuaacuaugaucuuuacuugccggaagagaaaguccugcccaagcacagucuccuguaugaaacauuugcaguguacaaugagcuuaccaaagugaaguucaucgccgaaggccugcgcgacuaccaauuuuucgauagcgggcagaagaaacagaucgucaaccaguuguuuaaggagaaaagaaagguuacugagaaagacauuauacauuaucuccacaauguggauggauacgacgguaucgaacugaagggcauugagaagcaauucaacgcuuccuuaucuacauaucaugaccugcuaaaaaucauuaaggauaaagaauuuauggacaaucacaagaaccaggagauccucgaaaacauaguacauacccugacgaucuucgaggauagggagaugauuaaacagcgucuugcccaguacgacagcaucuuugaugaaaaggugauuaaggcauugacccggcgacacuauacaggguggggaaaacugucagccaagcucaucaauggcauaugcgacaaaaagacugguaaaaccauucuggauuacuuaaucgacgauggguauaacaauagaaacuucaugcaacugauuaaugacgauggccuuaguuuuaaggagaucauacagaaggcucaggucgugggaaaaacagacgauuugacucagguugugagggaacucuccggcagcccugccaucaagaaagggauucugcaaucuaucaagauugucgacgagcuagugaaaaucaugggauacgcaccagaaucaauaguaauugagauggcgcgcgagaaccagaccacagcuaaggguaaaaagaauagucagcagcgguacaagagaaucgaagacgcccugaaaaaccucgcacccggccuggauagcaccaucuccaaggagaauccuacugacaacauucaacuucagaaugauagguuguuccuguauuacuuacagaacgggaaagacauguauacgggagaagcccucgauaucaaucaacugucuucguacgacauugaucacauaaucccacaggcuuucauuaaggacgauagccuugacaaccgcguucugacauccucaaaagauaaucgaggcaagagugacaacgugcccucuuuggaggucgugaagaaacggaaggccuuuuggcagcagcuccuggacagcaaacuaaucuccgagcguaaguucaacaaucugaccaaagcagaaagaggugggcucgaugagagggacaaggucggcuuuauuaagcgccaacugguggaaacucggcagaucaccaaacauguugcuagaauacuugaugccagguucaacacagaggugucagaaaagaaucagaaaauccgaagcguaaagauuaucaccuugaaaucuaaccuggucuccaauuuucgcaaggaguucaaguuauauaaagugcgggagauuaacgacuaccaccaugcgcacgaugccuaucucaaugcuguuguggcaaaggccauccugaaaaaguacccgaaacuugaaccugaguuugucuacggagacuaucagaaguacgaucugaagagauauauaaguaaaagcaaggaccccaaagaaguggagaaggcuacugaaaaauacuucuuuuauucuaaccuacucaauuucuuuaaggaggagguacacuacgccgauggcacaauugugaaaagggaaaacaucgaguauuccaaggacacgggggaaaucgcauggaauaaggagaaagauuucguuaccauuaagaaaguccugucauacccacaagugaacauagugaagaaacgugaaguccagacuggagguuucaguaaggagagcaucuugccuaagggcaauucggacaaacugauuccccgcaagacaaaagauaucuuaugggacaccacaaaguacgggggauuugacuccccaguuauugcguauucuauccuccugauagccgauaucgagaaaggcaaggcuaagaaacuuaagacugugaaaacccugguggguauuacgaucauggaaaaggccgcauucgagaaaaaccccauuaccuuuuuggaaaauaagggguaccauaacguacggaaggagaacauccucugucugccuaaauauagccuauucgagcuggaaaauggcagaaggcgacuucucgcuucagccaaggagcugcagaaaggaaacgaaauagucuugccaguguaccugacaacuuuacucuaucacaguaagaauguucauaaacuggacgagccggaacaccuugaguacauucagaagcaucgguaugaguuuaaagaucuguugaaccucguguccgaguucucucaaaaguacguccuggcagaagccaaucuagaaaagaucaaaagccuguacguggacaacgagcaggcugauaucgaaauucuugcuaauuccuuuaucaaccuccugaccuucacagccuugggcgcacccgcugccuuuaaguucuuugggaaagacguugaucgcaagagauauacuaccgugucagagauauuaaaugccacgcugauucaccagagcaucacaggacucuacgagaccaggauugaccugaguaaacuuggcgaagauuga

SEQ ID NO: 3147 - RNA, 4116 nt, Artificial Sequence
  Cas9 variant
augaccgagaagaacuacagcaucggccuggacauugggacaaauuccgugggaugggccgucauaacugaugacuauaaaguucccgcuaagaaaaugaaggugcucgguaacacggauaaaaaguacaucaagaaaaaucuucugggcgcauuguuauucgacaacggggaaaccgccgaggcgacaagacugaagaggacugcucggcgccgauauacccguagaaagaauaggcuacgguaccuccaggaaauuuuugccgaggaaauggcaaagguagaugagucuuucuuuuaucgccuggacgagucauuccuuacaaccgaugacaaagauuuugaaagacacccuaucuucggaaacaaggccgacgagauuaaguaccaucaagaauuuccaacuaucuaucaccugaggaaacauuuggcugauagucacgagaaggcagaccuccggcugauauaccuggcccucgcucauaugaucaaauuccgcggccacuuuuuaauugagggugaacugaaugccgagaacacagaugugcagaaacuuuucgaagcguuugucgagguguacgaccgaaccuucgacgauagcaauuuguccgaaaucacgguugacgcaucuucgauucugacugagaaauuuucaaagagcagaaggcuagagaaccucaucaaacacuauccgaccgaaaagaagaauacacuguucgggaaccuuguggcccuggcuuugggacuccagcccaauuucaaaaccaguuuuaagcuguccgaggaugccaaauuacaguucucuaaggacacuuacgaagaggaucuggaagaacucauaggcaaaauuggcgacgaguaugcagaucuuuuuacaagcgcuaagaaccuguacgacgccaucuugcuauccgggauucugaccgucgcggauaauacgacuaaggccccucucucagcaaguaugaucaaacgguauaacgaacaucaaguggaccugaagaaacuuaaggaguucaucaaaaacaaugcuagcgauaaguacgacgaaauuuuuaacgacaaggauaaaaauggauaugccgguuacauagagaacggcguaaagcaggacgaguucuacaaauaucugaagacaaccuugucuaaaaucgauggguccgacuacuuucucgauaagauugagcgugaggacuuccugcgcaagcagagaacuuuugauaauggaucaaucccacaccagauacauuuacaagaaaugcacgcuauucugaggcggcagggcgagcacuaugccuuccuaaaagaaaaccaggcaaagaucgagaaaauccucacauuucggauucccuacuauguugguccucuggcccgcaagaauagcagauucgcuugggcggaguaccauagugacgagaaaaucaccccauggaacuuugaugaaauuauagacaaggaaaaaucugcagagaaguucaucacgaggaugacccuuaaugauuuguaucugcccgaagagaaggugcucccuaaacacucccuggucuacgagacauacacuguguauaacgaacuuaccaaggugaaauacgucaaugagcagggaaagagcaacuucuuugacgccaauaugaaacaagaaauuuucgagcauguuuuuaaggaaaaccggaaggugacaaaagauaaguuccugaauuauuugaacaaagaguuuccagaguaccgcauccaggaccucaucgggcuggacaaggaaaacaaaucguucaaugcuucuuuaggcacuuaucacgaucugaagaagauucuagacaaauccuuucucgaugacaagaccaacgagacaauaaucgaagauauuauccagacccugacucuuuucgaggacagagauaugauuaggcaacguuugcagaaauacucagacaucuuuacgccgcagcagcugaagaaacucgaacggcgacauuauacaggcugggggagacugaguuacaaguuaauaaauggaaucaggaacaaggagaaugguaaaagcauucuggauuaccuuaucgacgauggcuaugccaaccgcaauuucaugcaauugauuuccgacgauacccuccccuuuaagcagaucauaaaagacgcacagauuaucggggacauugaugacguaacuucugugguccgggagcugccuggaagcccagccaucaagaaaggcauacuacagucagugaagaucguugaugaacuggugaaagucaugggucacaaccccgacaauauugugaucgagauggcuagagaaaaccaaaccacaaauagggggcgcaaccagagucagcagcgacucaagaagcugcaagauucccuuaaagaguugggcagcaauauucugaacgaggaaaagccuucuuacaucgagggaaaaguagaaaauaaccacuuacaggacgaucgacucuuccuguauuacauacagaacggcaaggacauguauaccggggaugagcuugacauugaucaucugucagacuacgacaucgaucacaucauuccacaggccuuuaucaaagacgauaguauugacaaucguguuuugacuagcuccgcaaagaacagaggaaagucugaugacgugcccucgcucgauauaguccaugacaggaaagcggauuggauccgccuguauaagagcggucuaauuuccaaacggaaguucgacaaucugacaaaagcugaaagaggcgggcucacggagaacgauaaggccggauucaucaagaggcaacugguggagacccgacagauuacuaaacacgucgcacagauccuugacucacgcuuuaauacagaacgggaugagaacgacaaggugauaagaaauguuaaagugaucaccuugaagaguaaccugguaucucaauucaggaaagacuuuaaguucuacaagguccgugaaauuaaugauuaccaccaugcccacgacgcuuauuuaaacgccgugguuggcacagcacuccugaaaaaguacccgaaacuugcuccugaguuuguguauggugaauacaagaaauaugauauccgcaaguucauuacuagcuccggggacaaggccaccgcgaaauacuuuuucuauucaaaucugaugaacuuuuucaagcgggucaucagauacagcaauggcaaagugguagugaggcccguuauagagugcucuaaggauacgggagagauugccuggaacaaacagaccgacuuugaaaagguccgacgggugcuauccuacccacaggugaauaucgucaaaaagguugagacacagacuggcggguucaguaaggaaagcauccucccuaaaggaaacucugauaagcugauuccccgcaaaaccaagaaauucagaugggacacaccaaaguaugguggcuuugauucccccaacauagcuuacucaguguucgugaucgcagacguagagaaggggaaagccaagaaauugaagacugucaaagaacuggugggaauuaguaucauggagaggagcucguuugaggaaaauccuguuguguucuuagagaagaagggcuaucaaaacguccaggaagauaaucucauuaaacugccaaaguacucccuuuuugaguucgagggugggcggcgaagacuguuggcuucugccagcgaacuccagaaaggcaacgaggugguucugucacgccaucuaguggaacugcuuuaucacgcacauaggguaaauaguuuuaacaauuccgagcaccucaaguacgucucugaacacaaaaaggaguucggagaggugcugagcuguguggaaaacuuugcgaaguccuaugucgacguugagaaaaauuugggcaagauccgugccguggcugauaaaauagacaccuucucaaucgaagacauuagcaucaguuuuguaaaccuguuaacgcucacagcccugggggcaccggcugauuucaauuuucuuggagagaagauuccccggaaaagauacaccucuacuaaggaaugccugaacgccacauugauccaucaguccauaaccggccucuacgagacuaggauugaccugagcaaacuaggugaggaauga

SEQ ID NO: 3148 - RNA, 4116 nt, Artificial Sequence
  Cas9 variant
augaaccugagaaauguggagagcuaccaggucggccucgacaucgggaccggauccguugguugggccgugcuugaugacaacggcgaucugugcagguucaaggggaaacccacauggggaucucggguauuuccuacugcugaaacggcagccgaggcgcgcgugcaccgaggccaacguagaagguaugaccggcgcagacagaggauugauuuguuacagcgguucuuugcugacgaagucgccaagguggauccagaguucuuuauacgccugaaucaggcacgacuacauccggaaaacagagaccccgcccacgcugauuacagguggccucucuucaaugguucaaacuuuaccgagaaagacuauuaccggcaauucccaacaaucuaucaucugcgugcacaccuucugaagagugaugagcccgccgacauucgcuugguuuaccucgcucugcauaauaucgugaaacacagagggaacuuucugcaccaggauaauccuagccucuccgccaggaacgcgaaugucggagacgcaguggaagccuuaugucuggcucuugacgaguggugcggcgcccaugauguagaaugugcaugcgacgaggcugccuuggcggaggcccugggcgaugcaucucuacggccaggggaaaagcgagagcgcgcugaagccgcucucggaguugagaaggcccacaaaaagcuggcaaaagccgugucgucagcugucguggguuaugcggcagaauuuggccauguguuuuucgccgagagcgaggggaguaaguuugcucuuuccaacgacgaaaaagucgaggccuacguuugucccgaugaaggaagagaccuguucgaugcaaugagggccgugcacucuagcuacguauugaugggcauucucuccgaggcucagggugaacuguuaucagugugcaaggucggggaguaugagcgguacaagcgcgaccuggaaacucucaaaagucuugugagagccuauggaccugagagguacgaugaguucuuuuguggcccauucuaugaaggcacccgugacuacgauccggggaaggcacagggauauacaaaauacaaucugggugcgagcaaguugucucacgaagacuuucuaaaagagguucaaaagcugcucaaagacaucggcgcucaggccgaugagcgguacgcagacauagaacgagccaucgaggcuggggccuuccugagaaggcuuaagaccuccgauaacggaacuauucccuaucagcugcauuuggaagagauggacgcaaucauugagcgccaggcugccuuuuacccuuuccucgcgcaagaaaaggauaaacugaagucauuagugagcuuucggaucccauauuacgucggcccccugacacagaaaaaugccgcuagagacgguaagggggaggcaagguucgccuggaguucucgcaaaccuggcauggaagaugcucgaguguauccauggaacugggaggacguaauagauaaggaccaguccgccgaagauuuuauucggcguaugaccggaacgugcacuuaccuaaagggcgagcccguucucgcaagauguagccuggacuaugagcuuuucugcguguugaacgaacuggcgggggccagguggacccaagauggagacaaaucguaccgcuuugacgcugccgaucggcucgguaucgucgaggaccuguucaagaaaagaaagagggugacauacgaagcagcugagaaauggcuugcccgaacucacggcccggaaucugggaaguccgcaggaggcgccuaucaugucucaggugggcagggcgaggaugcuuuugagagucagcugagcucccacuacgacuucuguaagauuuugggaguggaugaacucucugacgcggaugaggccauggcagaagacaucauccuguggaauaccguuuucgaggaucgcagcauuuuaaaacggaagauaaaacuggcuuauggcgacagacuaggggaugcccaggugaggaagcucugccaaaaacguuacacaggauggggucgccugucaggcgaacuuuugcgggggcugagaagugccaccgacaacggaccuaagacgaucauggauauucuccuggagggcgaccccaaucaugcuaggcgaaugggugcagccaugaacuuaauggagauccugcacgacgaucuuuuggaauuucaggcgaagauagacgagcacaaucgggaacgcgcucucgccguagggggcauguccgucgaugaggugacuggaagcccagcacugagaaggggcauuaaccaggcccuacggguuguggacgagaucgcugggaucgcaggaaaaccucccgcccauauuuaugucgaagugacacgagaugagggcgcgagaaauaagggucgcaggaccacuucucguuaccgggcucuggaagccgcacucucaaguaucaaagcccagugcgcugacguauaugccgagcugaaggaaagagauccaagggcacuugacgaugagcgcuugacacuguacuucaugcaaugugggaaaugcauguacagcggagacgcuuuagauauuaacaagcuccagaccuaucagguggaccacauacugccccaguccuacguuaaagacgauucuuuugagaauaagguccuugugcgaccugacacgaaccaaagaaagggcgauacccuguugcucgacgaacggcugaucgccaggaugcgcgguuucuggcguacacuaagagaugcggagcugauuggcgagaaaaaguuuaauaaccucacucggaccucggugagcgacgaacagaugaaaaaguucgucuccaggcagcugguugaaacagggcagauggugaaacaagugcagcagcuuuugcaagcccgcuauccagagucagagguacagccggucaaggcaggagugagucaucagcugcgaguuggcugugcuuuagccaagucuagagaaaucaaugauuuucaccacgcucaugacgcauaccucgccugccagguggggcgguucguccaauauaggcacagcgccguguacuccgagcccguuaaaauggcugcggugguaaagcaguuuaucaaaaagcaggcagaagauuaucgcagaacuagggagcugccuggaucagacggcuucauugucagcucuuuuaugaccccagguuucgaugugaaaacaggggaaguguuucgggacgccugggaugcuggagccgagauagaccguauccgccgauguuucgacuacaaggauugcuucauuuccagaaugcccgaggaaacccauggcgcauuuugggacgccacuaucuacaguccuagggcugcggguaagacgcuuagccugccacuaaaacggggccucgauccccgcaaguaugggucuuacuccagagagcaguucgccuauuucuucgucuacgaagcaguuaaaccgaagaaaaagcaaagggugcuggaguuugcuccuguaccagugcgggucgccucagcauuggccaacgaccccgaugcucuggaggacuaugcccgagaauuagcggaggcagaaggacucguguucgagcgcauuagaaggcggaagguuuacaaauaucagcagaucauagugggcgauagucgucuguacgucacagggagagaagaggugaggaaugcccgccagcuugcuuuuagccaagacgagaccaagcugaucugucggauugaacagggagaggaaugcgaggaaggcgaguugcucgaucuguuccgaucgaugcagagaaaauaccuagccugugcuccuaggcuggcacgccuuaugaagguugccgagauggaagaggguuuuaucgcugccacugcauccgggaaacgggaagugcuccugucuuugaccagcauugcggccgcucacagaaacucaaucgaccugaagcccauaggacguaaaggcaguuccggucaaaugaagauuacauucucuaaggaguuaagcaccaacggcauccucuuugucgauuccucaguaacugggauguucgaaaggcggugccgccugggacuuuga

SEQ ID NO: 3149 - RNA, 4116 nt, Artificial Sequence
  Cas9 variant
auggagaacaagaauuacagcaucggccuggacauugggaccaacuccgugggauggucugucauaacagaugacuauaaaguucccucaaagaaaaugaaggugcucgguaauacugauaaaagauucaucaagaagaaccuuauuggcgcccuguuguuugacgaagggacgaccgcugaggcaaggcgguuaaaacgcacagcccgacguagauacacuaggcggaagaaucgccugagauaucuacaggaaaucuucgcggaggaaaugaguaaaguagauagcuccuuuuuccacaggcucgacgauucuuuucugauuccugaggacaagcggggaucgaaauacccaaucuucgcuacccuugccgaggaaaaggaguaucauaagcaauuuccgacaauauaccaucugcgcaaacaguuggcagauucaaaggagaaaaccgaccuccgacugaucuaucuggcccucgcucacaugauuaaguacagaggccacuucuuauacgaagauacuuuugacaucaaaaacaaugauauucagaagaucuucagcgaguuuauaaguauuuaugacaacacauucgaagguuccucucugagcgggcagaaugcacaaguggaggccaucuuuaccgacaaaauuuccaagucagcuaagagggaacggguccuuaaauuguuccccgaugagaagaguacgggacuguucagcgaauuucuaaaacucaucgugggcaaccaggccgacuucaagaaacauuuugaucugggcgagaaggcgccucuucaguucucuaaggacacuuacgaugaggaccuggaaaauuugcucgggcagaucggagaugacuuugcagaucuguucuuaguugccaaaaagcuguaugacgcuauucuccuuuccgguauacugaccgugacagauccaucaacuaaagcccccuugagcgcaaguaugaucgagcguuacgaaaaccaccaaaaggaccuagcuguccugaaacaguuuauuaagaauaaccucccugagaaguaugacgaaguguucucugaucaguccaaagacggcuacgccggguauaucgauggaaagaccacacaggaggcguuuuacaaauacauaaagaaucugcuuagcaaauucgagggcaccgacuauuuucuggaaaagauugagcgcgaagauuucuugagaaagcaaaggacguuugacaacgguucgaucccacaccagauccaucuccaggagaugaacgccauucugcggcgacaaggggaacacuaccccuucuuaaaagauaauaaggagaaaaucgagaagauucugacuuuccgcauaccuuauuacguaggaccacuagcaagaggcaacagggacuuugcuuggcucacacgcaauucugaugaagccauccggccguggaacuucgaggaaauuguugacaaggcuuccucagccgaggauuuuaucaauaaaaugaccaacuaugaccuguaccuucccgaggaaaaaguguugccuaagcauagucugcucuaugagacuuucgcagucuacaaugaacugacaaaggugaaauuuaucgccgagggccuuagagauuaccaguuccuggacagcgggcagaagaaacagauugugacccaauuguuuaaggagaaaaggaaggucacggaaaaggacauaauccaguuccuccacaacguugauggauaugacgguauugagcugaaaggcaucgaaaagcaguuuaaugcuuccuuaucuaccuaccacgaucugcuaaaaauuaucaaggacaaagaguucauggaugacagcaagaacgaagagauacucgaaaauaucgugcauacacugacuauuuuugaggaucgugagaugaucaagcagcggcuugcgcaauaugacucauuguucgaugaaaaaguaauuaaggcacugauccgaagacacuacaccggguggggaaaacucagugccaagcugauagacggcauuugcgauaaacagacagguaacacuaucuuagacuaucugauugaugacgggaagaauaacaggaauuuuaugcagcuuaucaacgacgauggcuuguccuucaaggagauaacccagaaagcucaaguggucggaaagacagacgaugugaaacagguugugcaggaacucccaggcagccccgccaucaagaaagggauucugcagucuaucaagauugucgacgagcuagugaaaguaaugggacauaccccugaaucaaucguuauagagauggcacgcgagaaccaaacuacggcccgggguaagaagaauagucagcagagauacaaaaggauugaagaugcucugaagaaccucgccagcggccuggacuccaauauccuuaaagagcacccaacaaacaauauccaauugcagaacgaucgccuguucuuauauuaccuccagaaugggcgagacauguacaccggaaagccccuggauauuaaccagcuuucuucguaugacaucgaucauauugugccgcaagcauuuauaaaagacgacagccuggauaaucgggucuugacuucccucaaggacaaccguggcaagucagauaaugugccuaguaucgaagucgugcagaaaagaaaggcguucuggcagcagcugcuagacucuaaacugauuagcgagaggaaguuuaacaaucucaccaaagcugagcgcggugggcuggaugaacgggacaagguuggcuucaucaagagacaacuuguggagacaaggcagauuaccaaacacguagcccagaucuuggaugcacgauuuaacaaggaagucaaugagaaagacaagaaaaaccgcacugugaagauaaucacacugaaguccaacuuaguuucaaauuuccggaaagaauuuagacucuacaaggugagggagauuaacgauuaucaccaugcccacgacgcuuaccugaaugccgucguggcaaaagcuauccuuaagaaauaucccaagcuggagccagaauuuguauacggagauuaucagaaguacgaccuaaaacguuacauuagccgcucucggaacccuaaggagguggaaaaagccacggagaaguauuucuucuacuccaaucuccugaacuuuuucaaagaagagguucauuaugcggauggcaccaucgucaagagagagaauauagaauacaguaaagacacuggggagauugccuggaacaaggaaaaggacuucgcuacaaucaaaaagguguugagcuauccccaagugaauaucgucaaaaagagggagguucagaccggagguuuuucuaaagaauccauucugccaaagggcaacucagauaaguuaauaccccgaaaaacaaaggacauccucugggagacuaccaaauacgggggauucgauaguccugugauugcauauagcauccugcuuauugccgacaucgagaagggcaaagcuaagaagcugaaaacggugaagaccuugguagguauaacaaucauggaaaaagccgcauuugaggaaaauccaauuacuuuccucgagaacaagggguaccacaauguccggaaagagaacauccugugucuaccgaaguacucgcuguuugaacuugagaauggccgcagaaggcuccuggcguccgccaaggaauugcagaaaggaaacgagauugugcugcccguuuauuuaaccacacuccuguaccacucuaagaacgugcauaaacuugaugaaccugagcaccuggaguauauccaaaagcaucggaaugaguucaaagacuugcucaaccuggucagcgaauuuucacagaaguacgugcuagcugaugccaaucuggagaaaauacagaaccuuuaugcagacaaugaacaggcugauauugaaauccucgccaacaguuucaucaaucuguugacuuuuaccgcauuaggcgccccagcugcguucaaguuuuucgggaaggacauugaucgaaaaagauacacgacaguuuccgagauccugaacgccacccucauacaccaaucuauuacuggacuguaugagacacgcaucgaccuuagcaagcugggcgaagauuga

SEQ ID NO: 3150 - RNA, 4116 nt, Artificial Sequence
  Cas9 variant
auggacaagaaauacagcaucggccuggauauugggaccaacuccgugggaugggccgucauaacagacgauuauaagguucccucuaaaaaguucaaagugcucgguaauacugacagacacucaaucaagaagaaccuuauuggcgcucuguuguuugauaguggggagacggcagaagccaccagguuaaaacggacagcgcgccgacguuacacuagaaggaagaaucggauccgcuaucugcaggagauuuucagcuccgaaaugucuaaaguagacgauucguuuuuccauagacuagaggaaucauuucucguggaggaggacaagaaacacgaaaggcauccuaucuucggaaacauagucgaugagguggcuuaccacgaaaaguauccaaccaucuaccaucugcggaagaaacuugccgacagcacagauaaggcagaccugcgcuugauuuaucucgcccuggcucacaugaucaaauuucgaggccacuuccugauugagggugaucucaauccggacaacagugacauggauaaguuauuuauccaacugguucagaccuacaaucagcuuuucgaggaaaaccccauaaaugcauccagaguggacgccaaagcuauuuugucugccaggcugagcaagucccggcgucuagagaaccucaucgcgcagcugccuggggaaaaacgcaauggacuuuuuggcaaccugauugcauugucacucggccugacuccaaauuucaagaguaacuuugauuuagccgaggacgcuaagcugcaacucagcaaagauacauacgacgaugaccuugauaaucuguuggcccagaucggggaccaguaugcagaucuauuccuggcugccaagaaccucucugacgcgauccugcuuuccgacauucugagagucaacucagaaauaaccaaagcccccuugagcgcaaguaugaucaagagguacgaugagcaucaccaggaccucacgcuguuaaaagcucuggugcggcaacagcuaccugagaaguauaaggaaauuuucuuugaucagucuaaaaauggauacgccgguuauaucgacggcggggcuucccaggaggaguucuacaaguuuauaaaaccaauucucgaaaagauggauggaacugaggaacugcuugccaaauugaaccgagaggaccugcuccgcaagcaaagaaccuucgauaauggcagcaucccccaucagauccaccugggugaacuucacgcaauucugaggcggcaggaggacuuuuauccuuucuugaaggauaaccgcgaaaagaucgagaagauucucacauuuagaauaccauacuacguagggccgcuggccaggggaaauucgcguuucgcuuggaugacucggaaaucugaagagaccaucacacccuggaacuuugaggaaguuguggacaagggcgcguccgcacaaucauucauugagcgaaugaccaauuuugauaaaaacuuaccuaaugaaaagguccugccaaagcauagucuacucuaugaguacuucacgguguauaacgagcugacuaaagugaaguacgucacagaaggcaugagaaaacccgaguuucuuagcgggaagcagaaagaagccaucguugacuugcuguucaagaccaauaggaaagugacuguaaagcagcucaaggaggauuauuucaaaaagaucgaaugcuuugacuccguggagauuucuggagucgaggaccgcuucaacgcuagccuggguacauaccacgauuuacugaaaauaaucaaggacaaagauuuucuugacaaugaagagaacgaagauauuuuggaggacaucgugcucacccugacgcuauucgaagauaaggagaugauugaggaacggcugaagaaauaugccaaucucuuugacgauaagguuaugaaacagcugaagagaaggcauuacaccggcugggggcgccuuucacgaaaauugaucaacggaauacgggacaagcaaaguggcaagacaauccuggauuucuuaaaauccgacgguuuugcaaaccguaauuucaugcagcucauuaacgaugacagccugacuuuuaaggaggccauccagaaagcucaggugucugggcaaggccacucacuucaugaacagauugccaaucuggcaggaaguccugcgaucaagaaaggcauauugcagagcgucaaggugguagacgagcucguuaaggugauggggcacaaaccagaaaacauugucaucgagauggcuagagagaaucagaccacacaaaagggacagaaaaacuccagggaacgcaugaagcggauugaggaagguaucaaagagcugggcucucagauacuaaaggagcaccccguggaaaauacucagcugcaaaacgagaaacucuaccuguauuaccuucagaaugggagagauauguaugucgaccaggaauuggauaucaacaggcugucggacuacgauguggaccauauuguuccgcagagcuucaucaaggaugacuccauugauaauaagaucuuaacccgaucagacaaaaaccgcggaaagagugauaaugugccuucugaggaaguagucaaaaagaugaaaaacuauuggcggcaacuccugaaugccaaacuuauaacacagagaaaguuugacaaccugaccaaagcagagaggggcggucuaagcgagcucgacaaggccggguucauuaaacgucagcugguggaaacucgccaaaucacgaagcacguugcucagaucuuggauucccggaugaacacaaaauacgacgagaaugauaagcugauuagagaagugaaggucaucaccuuaaaaucaaagcucgugagcgacuuuaggaaagauuuccaguucuauaagguacgagagauuaacaauuaccaucacgcccacgacgcauaccugaacgcugugguuggcacugcccuuaucaaaaaguauaccaagcuggaaucugaguuugucuacggagauuauaaaguguacgacgugcggaagaugauagcgaaauccgagcaggaaauuggcaaggccacagcuaaacgcuucuuuuauaguaauaucaugaacuucuuuaagaccgagauuacuuuggcaaauggggaaaucagaaagaggccccucauagagacaaacgaagagacgggagagaucgucugggauaaaggucgggacuucgccaccguucgaaaggugcugagcaugccacaagugaauauugucaaaaagacugaaguacagacaggcgcucuaaccaacgagucuaucuacgccagaggguccuuugauaaacugauuucacgcaagcauagguucgaaaguagcaaauauggaggcuuugguucgccuacagugacuuacuccguucuuguggucgcaaagucuaaggugcaggacgggaaaguuaagaaaaucaagaccggcaaagagcucauaggaaugacgcuguuggauaagcugguguucgagaagaaucccuuaaaauuuauugaagacaagggcuacgggaacguacagaucgacaaauguaucaagcucccaaaauauagccuguucgaguucgaaaauggaacccgucggaugcuugcgucagucauggccaacaauaacaguagaggcgaucugcaaaaggcuaacgagauguuuuugcccgccaagcucgugacacugcuauaccacgcacauaaaauugaauccucuaaggagcuggagcacgaggcuuauauacuugaccauuacaaugaucucuaucagcuguugagcuacaucgaaagguucgccuccuuauauguggacgucgagaaaaacauuucaaagguuaaagaacuguuuagcaauaucgaaaguuacucuauuuccgagaucugcagcucggugauaaaccuccugacucuuaccgcaucaggugccccugcugauuucaaguuucuggggacaacuaucccacgcaagcgauacggaucuccgcagaguauuuuguccagcacccuaauccaccaaucuauuacgggccuguaugagacaagaaucgaccucagccagcuggguggcgauuga

SEQ ID NO: 3151 - RNA, 4116 nt, Artificial Sequence
  Cas9 variant
auggacaagaaauacagcaucggccuggauauugggaccaacuccgugggaugggccgucauaacagacgauuauaagguucccucuaaaaaguucaaagugcucgguaauacugacagacacucaaucaagaagaaccuuauuggcgcucuguuguuugauaguggggagacggcagaagccaccagguuaaaacggacagcgcgccgacguuacacuagaaggaagaaucggauccgcuaucugcaggagauuuucagcuccgaaaugucuaaaguagacgauucguuuuuccauagacuagaggaaucauuucucguggaggaggacaagaaacacgaaaggcauccuaucuucggaaacauagucgaugagguggcuuaccacgaaaaguauccaaccaucuaccaucugcggaagaaacuugccgacagcacagauaaggcagaccugcgcuugauuuaucucgcccuggcucacaugaucaaauuucgaggccacuuccugauugagggugaucucaauccggacaacagugacguugauaaguuauuuauccaacuggugcagaccuacaaucagcuuuucgaggaaaaccccauaaaugcauccagagucgacgccaaagcuauuuugucugccaggcugagcaagucccggcgucuagagaaccucaucgcgcagcugccuggggaaaaacgcaauggacuuuuuggcaaccugauugcauugucacucggccugacuccaaauuucaagaguaacuuugauuuagccgaggacgcuaagcugcaacucagcaaagauacauacgacgaugaccuugauaaucuguuggcccagaucggggaccaguaugcagaucuauuccuggcugccaagaaccucucugacgcgauccugcuuuccgacauucugagagugaacucagaaauaaccaaagcccccuugagcgcaaguaugaucaagagguacgaugagcaucaccaggaccucacgcuguuaaaagcucugguacggcaacagcuaccugagaaguauaaggaaauuuucuuugaucagucuaaaaauggauacgccgguuauaucgacggcggggcuucccaggaggaguucuacaaguuuauaaaaccaauucucgagaagauggauggaacugaagaacugcuugccaaauugaaccgagaggaccugcuccgcaagcaaagaaccuucgauaauggcagcaucccccaucagauccaccugggugaacuucacgcaauucugaggcggcaggaggacuuuuauccuuucuugaaggauaaccgcgagaaaaucgaaaagauucucacauuuagaauaccauacuacguugggccgcuggccaggggaaauucgcguuucgcuuggaugacucggaaaucugaagagaccaucacacccuggaacuuugaggaaguggucgacaagggcgcguccgcacaaucauucauugagcgaaugaccaauuuugauaaaaacuuaccuaaugaaaaggugcugccaaagcauagucuacucuaugaguacuucacgguguauaacgagcugacuaaagucaaguacguuacagaaggcaugagaaaacccgccuuucuuagcggggagcagaagaaagcuaucguggacuugcuguucaagaccaauaggaaaguaacugugaagcagcucaaggaagauuauuucaaaaagaucgagugcuuugacuccgucgaaauuucuggaguggaggaccgcuucaacgccagccuggguacauaccacgauuuacugaaaauaaucaaggacaaagauuuucuugacaaugaggaaaacgaggauauuuuggaagacaucguucucacccugacgcuauucgaggauaaggaaaugauugaggagcggcugaagaccuaugcacaucucuuugacgauaaagugaugaagcagcugaaaagaaggcacuacacaggcugggggcgccuuucacgaaaguugaucaauggaauacgggacaaacaaaguggcaagacuauccuggauuucuuaaaguccgacgguuuugccaaccguaacuucauucagcucauccaugaugacagccugaccuuuaaagaagcuauucagaaggcccaggucucugggcaaggccacucacuucacgagcagaucgcaaaucuggcgggaaguccugcuauuaaaaagggcauauugcagagcgugaaaguaguugacgaacucgugaaggucauggggcauaagccagagaacaucgugauugaaauggccagagagaaucagacaacucaaaaaggacagaagaacuccagggagcgcaugaaacggaucgaagaggguauaaaggaacugggcucucagauccuaaaagagcaccccgucgagaauacccagcugcaaaacgaaaagcucuaccuguauuaccuucagaaugggagagauauguauguggaccaggaguuggauauuaacaggcugucggacuacgauguugaccauaucgugccgcagagcuucauuaaagaugacuccaucgauaauaagguauuaacacgaucagacaagaaccgcggaaaaagugauaaugucccuucugaagaggugguuaagaaaaugaagaacuauuggcggcaacuccugaaugcaaaacuuauaacccagagaaaguuugacaaccugacuaaggccgaaaggggcggucuaagcgagcucgacaaagcuggguucauuaagcgucagcugguggagacgcgccaaaucacaaaacacgucgcccagaucuuggauucccggaugaauaccaaguacgacgaaaacgauaaacugauuagagaggugaagguaaucacuuuaaagucaaaacucgugagcgacuuuaggaaggauuuccaguucuauaaaguucgagaaauuaacaauuaccaccaugcacacgacgcuuaccugaacgccgucgugggcaccgcgcuuauaaagaaauaucccaagcuggagucugaauuuguguacggagauuauaaggucuacgacguucggaaaaugaucgccaaguccgagcaggagauuggcaaagcuacagcaaagcgcuucuuuuauaguaauaucaugaacuucuuuaaaaccgaaauuacuuuggccaauggggagaucagaaagaggccacucauagaaacaaacgaggaaacgggagagaucgugugggauaagggucgggacuucgcuaccgugcgaaaaguacugagcaugccucaagucaauauugugaagaaaacugagguucagacaggcgcccuaaccaacgaaucuaucuacgcaagaggguccuuugauaagcugauuucacgcaaacauagguucgagaguagcaaguauggaggcuuugguucgcccacagugacuuacuccguccuugugguugcgaaaucuaaggugcaggacgggaaggucaaaaagaucaaaaccggcaaggaacucauaggaauuacgcuguuggauaaacugguauucgagaagaauccauuaaaguuuaucgaggacaaaggcuacgggaacgugcagaucgacaaguguauuaaacuccccaaguauagccuguucgaguucgaaaauggaacccgucggaugcuugccucagugauggcuaacaauaacaguagaggcgaucugcaaaaagccaaugaaauguuuuugccugcaaagcucgucacacugcuauaccacgcucauaagauagaguccucuaaagaacuggagcacgaggccuauauccuugaccacuacaacgaucucuaucagcuguugagcuacauugaaagguucgcauccuuauauguugacguggagaagaacaucucaaaaguaaaggaacuguuuagcaauauugagaguuacucuaucuccgaaauaugcagcucggugaucaaccuccugacucuuaccgccucaggugcuccagcggauuucaaauuucuggggacaacuauuccgcgcaagcgauacggaucuccccagaguaucuuguccagcacccuaauucaucaaucuaucacgggccuguaugagacaagaauagaccucagccagcuggguggcgauuga

SEQ ID NO: 3152 - RNA, 4116 nt, Artificial Sequence
  Cas9 variant
auggagaacaagaauuacagcaucggccuggacauugggaccaacuccgugggauggucugucauaacagaugacuauaaaguucccucaaagaaaaugaaggugcucgguaauacugauaaacacuucaucaagaagaaccuuauuggcgcccuguuguuugacgaagggacgaccgcugaggcaagaagguuaaaacggacagcccgccgacguuacacuagaaggaagaaucggcugcgcuaucuacaggaaaucuucagugaggaaauuggaaaaguagauagcuccuuuuuccauagacucgacgauucuuuucugaucccugaggacaagaggggcucgaaauacccaauauucgcgacccuugcugaggaaaagaaguaucacaaacaauuuccgacaaucuaccaucugcggaagcaguuggccgauucaaaagagaagaccgaccuccgccugauuuaucuggcacucgcccacaugaucaaauaccgaggucauuucuuauacgaagaggcuuuugauauuaagaacaaugacauccagaaaauauucaacgaguuuauuagcaucuauaauaacacuuucgaagggaauagucuguccggacagaacgugcaagucgaggcaauuuuuacagauaagaucucuaagagcgccaaaagagaaagggugcuuaaguuguuccccgacgagaaauccaccggccuguucucagaauuucuaaagcucaucguuggcaaucaggcugacuucaaaaagcacuuugaucuggaggagaaggccccucuucaguucagucgggacacguacgaugaagaccuggagaacuugcucgggcagauuggagaugacuuugcggaucuguucuuaguggccaaaaagcuguaugacgcaauacuccuuagcgguauccugacugucaccaauccaucuacaaaagcucccuuguccgccucaaugauugaacguuacgagaaccaccaaaaggaucuagcaagccugaaacaguuuaucaagaacaaucucccugaaaaguaugacgagguguucagugaucagucugaggacggcuacgcuggguauauagacggaaaaacuacccaggaaacauuuuacaaguacauuaaaaaccugcuuuccaaguucgagggcgccgauuauuuucuggacaaaaucgaacgcgaggauuucuugagaaagcaaaggaccuuugacaaugguagcaucccacaucagauucaccuccaggaaaugaacgcgauccugcggcgacaaggggagcauuaccccuucuuaaaggagaauaaagaaaagauugagaaaauacugacguuccgcaucccuuauuacguaggaccacuagccagaggcaacagggauuuugcauggcucacucgcaauucggaccaggcuauucggccguggaacuucgaagagaucguugauaaggccucuuccgcugaggacuuuaucaauaaaaugacaaacuaugaucuguaccuucccgaagagaagguguugccuaaacacucacugcucuaugaaaccuucgccgucuacaaugagcugacuaaggugaaguuuauugcagaaggccuuagagacuaccaguuccuggauagugggcagaaaaagcaaauagugacacaguuguuuaaagagaagaggaaagucaccgagaaggacaucauucaguuccuccacaacguugauggauaugacgguaucgaacugaagggcauugagaaacaguuuaaugccagcuuauccacguaccaugaccugcuaaagaucauaaaagauaaggcuuucauggacgaugcgaaaaacgaagcaauccucgagaauauugugcacacccugacaaucuuugaagaccgugagaugauuaagcaacggcuugcccaguaugauucuuuguucgacgagaagguaaucaaagcucugacucgaagacauuacaccggguggggaaagcucagcgccaaacugauaaacggcauuucagauaagcagacagguaacacuaucuuagacuaucugauugaugacggggaaaucaauaggaacuuuaugcagcuuauaaaugaugacggcuugaguuucaaagagaucauucaaaaggcacagguggucggaaagaccaacgaugugaaacagguugugcaggaacucccaggcucccccgccaucaagaaagggauucugcaaagcaucaagauagucgacgagcuagugaaaguaaugggacacgcuccugaaucuauuguuaucgagauggcccgcgagaaucagacaaccgcacgggguaagaaaaacucacagcaaagauacaagaggaucgaagacagucugaagauucucgcgagcggccuuaauuccaaaauccugaaggagcauccaacugauaacauucaguugcagaaugaccgccuguucuuauauuaccuccagaacgggaaagauauguacacgggagaagcucuggacauaaaucaacuuucuucgugcgauaucgaccacauuaucccccaggccuuuauuaaggaugacagccuggauaaccgaguguugacauccucaaaagacaaucggggcaagagugauaacgucccgucucucgagguggucgacaagaugaaaguguucuggcagcagcugcuagacagcaagcugaucuccuaucguaaauuuaauaaccucaccaaggcagagagaggugggcugaacgaacuugauaaaguuggcuucauaaagaggcaauugguggagacucgccagaucaccaagcacguagcccagauucuggacgcucgguuuaauaaagaagucacagagaaggauaaaaagaacagaaccgugaaaaucauuacuuuaaagucaaaucucguuagcaacuucaggaaggaauuugagcuguacaaagugcgagagaucaaugacuaucaucacgcccaugaugcauaccuuaacgcugucguggccaaggcgauacugaaaaaguauccuaaacuagaacccgaguucguauacggagacuaucagaaguacgaucucaagcgcuacauuucucgguccaaagacccaaaggaaaucgagaaagccacagaaaaguacuuuuucuauaguaaucuguugaacuuuuucaaagaggaggugcacuaugcugauggcacgaucguuaagagagaaaauauugaguacagcaaagacaccggggaaauagcauggaacaaggagaaggauuucgccacuaucaaaaagguccugucuuuaccucaagugaauauugugaaaaagagggaaguccagacaggagguuuuuccaaagagucaauccuccccaagggcaacagugacaagcugauuccacguaaaaccaaggauauccuuugggacacaacuaaauaugggggauucgacagccccguuauagcuuacucgauccuguugauugccgauaucgagaagggcaaagcaaagaagcucaaaaccgugaagacgcugguggguauuaccaucauggaaaaagacgcguuugagaagaauccuauagccuuccuagaaaacaaaggguaucacaauguauguaaggagaacauucugugccuuccaaaguacucccucuuugagcuggaaaacggccgccggagauugcuggcuucugccaaagaguuacagaaguguaaugaaaucguccucccgguguaccugacaacucuucuguaucauagcaaaaacguucacaaguuggaugagcccggacaucucgaauacauccaaaaacacaggaaugaguucaaggaccugcuaaaccuggugucagaguuuagucagaaauauguccuugcagaugcuaaucucgaaaagauuaagaaccuguacgccgacaaugagcaggcagauaucgaaauauuggccaacuccuucauuaauuuacugaccuuuacagcucucggcgcgccugccgcauucaaauuuuucgggaaggacguggaucgaaaacgguauacuaccguuucugagauccugaacgcuacgcuuauucaucagagcaucacaggacuguacgaaacccgcauagacuuguccaagcuaggcgaggauuga

SEQ ID NO: 3153 - RNA, 4116 nt, Artificial Sequence
  Cas9 variant
augaaggugaacaauuaccacaucggccuggacauugggaccagcuccauaggaugggucgccaucggugaggauggcaaaccccucagaauuaaggggaaaacagcuaucggagcaaggcuuuuccaggaaggcaacccugccgcggaccggcgcauguuucgaacuacgcguagaaggcugucucggcgcaaguggagauugaaauuacuggaggaaauuuucgauccauauaucaccccgguugacucaacauuuuucgcuaggcuaaagcaaaguaaucucagccccaaggauucccggaaagaguuuaaggguucuaugcuguucccugaccuuacugauaugcaguaccauaaagacuauccaaccauauaccaucugcgccacgccuugaugacacaggaugaaaaguuugacauccgaaugguguaucucgcaauucaccauaucguaaaauacagagggaacuuccuaaauucgacccccguggauucauuuaaggccagcaaggucaacuucguggaccaguuuaaaaagcugaaugagcucuauacugcuauuaacccugaggaaaguuuccaaaucaauuuagcaaacuccgaggauauaggacaccaguuucuggacccaucuauuaggaaauucgacaagaaaaagcagauccccaaaauuguuccugugagcgucgaugacaaggccacagauaagaucaauggcaaaaucgcuuccgaaauuauaaacgccauccuuggcuacaagucaaaauuggacgugguaguucagugcaccccaguggauaguaagagcugggcgcugaaauucgacgaggaggauauugacgcaaagcuacaaaagauccucccggaaauggaugagaaucagcagucuauaauugccauccugcagaaccuuuacucccaagucacgcugaaucagaucgugcccaacgggaugucauugagcgaaaguaugauugagaaauauaacgaccaccaugaucaccucaagcuguacaaaaagaucauugaccaguuagcugacccuaaaaagaaggccgcacugaaaaaggcuuauucucaauacgugggagaugacgguaaagucauagaacaggccgauuuuugguccagcguuaagaaaaaucucgacgauucggaccuuucuaagcagaucauggaucugauugacgcggagaaguucaugccaaaacagcggacuucccaaaacggcgugaucccccaucaguugcaccagcgugagcuagaugaaaucauugagcaccagucaaaguauuacccuuggcuggccgaaauaaauccaaacaaacaugaccuccaccuggcaaaguauaaaaucgaggaacuuguagcuuuucgcgugcccuacuacgucgggccgaugauuaccccugaugaccaagccaagagugcugagacaguguucagcuggauggagagaaaaggaaaggaagccggccagaucacucccuggaauuuugaugagaagguugacaggaacgcauccgccaaucgguucauuaaacgaaugaccacaaaggacaccuaucugaucggugaagauguguugccagacgagucucuccuguacgaaaaauuuaaggucuuaaacgagcugaauauggugcgcguaaacgggaaacuacucaagguugcugauaagcaggcgauauuccaggaccuguuugagaauuauaaacauaucagcgugaagaaacuucaaaacuacauuaagucaaaaacgggauugccuagugaucccgaaaucuccggccugagcgacccagaguauuucaauaacucucucggcacuuacaaugauuuuaagaagcuguucgggaacaaagucgacgaacccgaucuucaggacgauuuugagaagauuguggaguggucaacagucuucgaagacaaaagaauccugagggagaaguugaacgaaauaaccuggcucagugaucagcagaaagacgugcuggagagcucccgguaucaaggauggggucgcuuaucuaagaagcugcuaacuggcauuguuaaugaccagggggaaagaaucauugaugagcucuggaacacaaauaaaaacuucaugcagauccaaucggacaaugauuuugcaaagaggauacacgaggccaacgcugaccagaugaaagccguggauguagaagacguccuggcagaugccuacaccagcccucagaauaagaaagcuauccgucaggugguuaagguggucgacgauauucaaaaagccaugggaggcguggcaccaaaguacaucuccauugaguucacgcggucagaagaccgaaacccgagaaggaccaucagucgccagcggcagcuugagaauacauugaaggauacugcgaaaucucuggcuaagagcauaaaccccgaacuccuguccgaguuagacaaugccgcaaaaucaaagaaaggucugauugacagacuuuauuuguacuuuacccagcucgggaaggauaucuauacaggcaagccuaucaacauugacgagaucagcacuuacgauauugaccauauacugccacaagccuucguaaaagaugacucucuaaauaacagggugcugguuuccaaggcuaucaauaacggaaaaagugauaacguccccgugcagcucuuuggcgccaagauggggcacuucuggaaacagcuggcagaagcuggacuuauuagcaagcgcaaguugaaaaaucugcagaccgacccugauacaaucucuaaguaugccaugcacgguuuuauucgacggcaauuaguggagaccucccaggucaucaaacucguugcgaacauacugggcgacaaguaccguaaugaugacacuaaaaucauugaaaucacggccagaaugaaccaucagaugagggaugaguucggguuuauuaagaaucgcgaaaucaacgacuaucaccaugcuuucgacgcauaccuuacagccuuucugggacgguacuuguaucacagauacauaaagcucaggccauauuucguguacggcgauuuuaaaaaguucaaagaggacaaggugaccaugcgaaauuucaacuuucugcacgaucuaacugacgauacccaagagaaaauugcugacgccgaaacaggugagguaaucugggaucgcgaaaauucaauccagcagcugaaggacgucuaucauuacaaguucaugcucauuagucacgagguguauacccugagaggggcaauguuuaaccagacuguuuaccccgcgagcgaugccggcaaacggaaacuuauaccgaucaaagcugacaggccuauuaauguguacggaggcuauucgggguccgccgaugcauacauggcuaucguccguauucauaacaagaaaggagacaaguaucgcgugguuggugugccaaugcgggccagagauagguuggacgcagccaaaaagguaucugacgcugauuacgaccgagcgcugaaggaugucuuaacaccccaacucacgaaaaccaagaaaagccggaagacuggcgagaucacacaggugguggaagacuucgagauaguccuggggaaaguuauguaucgccagcuuaugaucgauggagacaagaaguuuaugcugggcucaaguaccuaccaguauaaugccaaacaacuggugcucuccgaucagucuguaaagacacuggcaagcaaagguagauuggacccucugcaggaauccauggauuacaacaauguguacacugagauuuuagacaaggucaaccaguauuucucacucuacgauaugaacaaauuuaggcacaagcugaaucuuggguucagcaaguuuaucaguuuccccaaccauaauguguuugacggcaacaccaaggcuucuuccggaaagcgggaaauucuggaggagguuuugaauggccuccacgccaacccaacguucgggaaucugaaagacaucggaauaaccacaccuuucggccaacuacagcagcccaacgguauucugcuuagcgaugaagccaagauccgauaucagucgccaacugggcucuuugagagaaccgugucacugaaagacuuguga

SEQ ID NO: 3154 - RNA, 4116 nt, Artificial Sequence
  Cas9 variant
augaaggugaacaauuaccacaucggccuggacauugggaccagcuccauaggaugggucgccaucgguaaagauggcaagccccucagaguuaaagggaagacagcuauuggagcaaggcuuuuccaggagggcaacccugccgcggaccggcgcauguuucgaacuacgcguagaaggcugucucggcgcaaauggagauugaaguuacuggaagagaucuucgauccauauauuaccccgguggacucaacauuuuucgcuaggcuaaagcaaaguaaucucagccccaaagauucccggaaggaauuuaaagguucuaugcuguucccugaccuuacugauaugcaguaccauaagaacuauccaaccaucuaccaccuucgccaugccuugaugacacaggacaaaaaguuugauauacgaaugguauaucucgcaauccaccauauugugaaguacagagggaauuuccugaacucgacccccgucgacucauuuaaagccagcaagguggauuucguugaccaguuuaaaaagcugaaugagcucuaugcugcaaucaacccugaagagaguuucaaaauuaauuuagccaacuccgaggauaucggacaccaauuucuggacccaucuauaaggaaguucgacaaaaagaagcagauucccaaaaucgugccugucaugaugaaugauaaggugacugaccggcuuaacggcaaaauugcuagcgaaaucauccacgccauuuugggcuacaaggcgaaacuggauguaguucuacagugcacaccaguggacuccaagccgugggcacucaaguucgaugacgaggauauagacgccaaacuggaaaagauccuucccgagauggaugagaaucagcaaucaauugucgcuauccugcagaacuuguacagucaggugacccucaaucagauagugccuaacgggaugagccugucugaauccaugauugagaaauauaacgaccaucacgaucauuuaaagcuguacaaaaagcucaucgaccaacuugccgacccaaagaaaaaggcaguccugaaaaaggcuuauucacaguacguuggagaugacgguaaagugaucgaacaggccgaguuuuggagcaguguaaagaagaauuuggaugacucugaacuauccaaacaaauuauggaucugaucgacgcggagaaguucaugcccaaacagcguacgagccagaacggcgugauuccucaccagcuccaccaacgcgagcuggaugaaauaaucgagcaucagucgaaguauuacccauggcuugucgaaauuaaucccaacaaacacgaccugcauuuggccaaguauaaaaucgagcagcucguggcauuuagaguuccguacuacguggggccuaugaucacucccaaggaucaggcugaaucugccgagaccgucuucuccuggauggagaggaagggaacagaaacuggccaaauuaccccauggaauuuugacgagaaaguggaucggaaggcuucagccaaccgauucauaaaacgcaugacaaccaaggacacguaucugaucggugaagauguauuaccugacgagagucugcuauacgaaaaauuuaagguucucaaugagcugaacauggugagagucaaugggaagcuguugaaaguggcagacaagcaggccauuuuccaggaucuguuugagaacuauaaacacgucagcgugaagaaacuccagaauuacaucaaggcuaagacuggacugcccuccgacccagaaauuucuggccuuagcgaucccgagcauuucaacaauucacugggcacauauaacgacuuuaaaaaguuguucgggaguaaaguugaugaaccugaccuccaagaugacuuugagaagaucguggagugguccaccguauucgaagauaaaaagauacugagggagaaguuaaaugaaaucacuuggcugagcgaccagcagaaagauguccuagagucuucacgguaccagggauggggucgccucaguaagaaacugcuuacaggcauugugaacgaccaaggggaaagaaucauugauaaguuguggaacaccaauaaaaacuucaugcagauccagagcgacgacgauuuugcgaagaggauacacgaggcaaaugccgaccaaaugcaggcuguugauguggaggacguccuggccgaugcauauacguccccacagaacaaaaaggccauucgucaggugguaaaggugguugacgauauccaaaaagcuaugggaggcgucgccccgaaguacauuucuaucgaguucacccggucggaagaccgaaaucccagaaggacaauaagccgccagcggcagcucgaaaacacucugaaagauaccgcaaaguccuuagcgaaaucaaucaauccugagcugcuuagugaauuggacaacgcugccaagucuaagaaaggucucacagauagacuguaccuauauuuuacucagcuggggaaggacauuuacaccggcgagccaaucaauauugacgagcucaacaaauaugauaucgaccacauacugccccaagcauucauuaaggauaauagccuugacaacaggguguuggugcugacagccgucaauaacggaaaauccgauaauguuccuuuacgcauguuuggcgcuaagauggggcauuucuggaagcagcucgccgaagcaggacugaucucaaaacgaaaacuuaagaaccugcagaccgacccagauacuaucagcaaguacgcuaugcacgguuuuauucggcgucaguugguggagacgucucaagugaucaaacucguagccaacauucugggcgacaaguauagaaaugaugacacaaagauaaucgaaauuaccgcgaggaugaaccaucagaugcgcgaugaguucggguuuaucaaaaaucgggaaauuaacgacuaccaccacgccuucgaugcuuaucuaacugcauuucugggaagauaccucuaccauagguauaucaagcugcgacccuacuucgucuauggcgacuuuaaaaaguuccgcgaggacaaagugaccaugcggaauuucaacuuucuucacgauuugacagacgauacccaggagaagauagccgacgcugaaacuggugagguuaucugggauagagaaaauuccauucaacagcugaaggacguguaccauuauaaauucauguuaaucagucacgaggucuacacacuccguggggccauguuuaaccagacgguguauccggcaagcgaugcgggcaagaggaaacugauuccuguuaaggccgaccgcccagugaauguauacggaggcuacucuggguccgcugaugccuauauggcaaucguccggauacauaacaaaaagggagacaaauacagagugguggguguccccaugagggcucuugaucgacuggacgccgcaaagaauguuucagaugccgacuucgaccgggcucuaaaggaugugcucgcgccucagcugaccaaaacuaagaaaagucgcaagacaggcgagauuacccaaguaaucgaagacuuugagaucguguuggggaaagucauguauagacagcugaugauugauggagacaagaaguucauguuaggcagcucgacauaccaguauaacgccaaacagcucgugcuguccgaucaaucuguuaagacucuugcaagcaaagguaggcuggaccccuugcaggaaucaauggauuacaauaacguguauaccgagauacucgacaaggucaaucaguacuuuagucuguacgauaugaacaaauuccggcacaagcuaaaccugggguuuuccaaguucaucucuuuuccaaaucacaacgugcuugacggcaauacgaaaguuagcuccggaaagcgagaaauucuccaggagauccugaacggcuugcaugcuaauccuaccuucgggaaccugaaagaugugggaauuacaacucccuucggccaauuacagcagccaaaugguauccuccugucagacgagaccaagauaagauaucagagcccgacagggcuuuuugaacgcacugucagucugaaagacuuguga

SEQ ID NO: 3155 - RNA, 4116 nt, Artificial Sequence
  Cas9 variant
auggacaagaaauacagcaucggccuggauauugggaccaacuccgugggaugggccgucauaacagacgauuauaagguucccucuaaaaaguucaaagugcucgguaauacugacagacacucaaucaagaagaaccuuauuggcgcucuguuguuugauaguggggagacggcagaagccaccagguuaaaacggacagcgcgccgacguuacacuagaaggaagaaucggaucugcuaucugcaggagauuuucagcaacgaaauggcuaaaguagacgauuccuuuuuccaucgccuagaggaaucuuuucucguggaggaggacaagaaacacgaaagacauccuaucuucggaaauauagucgaugagguggccuaccacgaaaaguauccaaccaucuaccaucugaggaagaaacuugcagacucgacagauaaggccgaccugcgguugauuuaucucgcucuggcacacaugaucaaauuucgcggccacuuccugauugagggugaucucaacccggacaauucagacguugauaaguuauuuauccaacuggugcagaccuacaaccagcuuuucgaggaaaaucccauaaacgccagccgagucgacgcuaaagccauuuugagugcgagacuguccaagucuaggcggcuagagaaucucaucgcacagcugccuggggaaaagaagaacggacuuuuuggcaaucugauugccuugagccucggccugacuccaaacuucaaguccaauuuugauuuagcugaggacgccaaacugcaacucucaaaggauacauacgacgaugaccuugauaaccuguuggcacagaucggggaccaguaugcugaucuauuccuggccgcgaaaaaccucagugacgccacccugcuuagcgacauccugcguguaaauucugaaauuacgaaggcacccuuguccgcuucaaugauaaaacgcuacgaugagcaucaccaggaccucacucuguuaaaggcccuggugagacaacagcuaccugagaaguauaaagaaaucuucuuugaucagagcaagaacggauacgcugguuauauugacggcggggccagucaggaggaguucuacaaauuuaucaagccaauacucgagaaaauggauggaaccgaagaacugcuugcaaaguugaauagggaggaccugcuccggaagcaacgaacauucgauaacggcucuauuccccaucagauccaccugggugaacuucacgccauccugcgcagacaggaggacuuuuauccuuucuugaaagauaauagggaaaagauugagaaaauccucacuuuucggauuccauacuacguugggccgcuggcucgcggaaacuccagauucgcguggaugacccguaagagcgaagagacaauaacccccuggaauuuugaggaaguggucgacaaaggcgcaucggcccaaucuuucaucgagaggaugacgaacuuugauaagaauuuaccuaacgaaaaggugcugccaaaacauucccuacucuaugaguacuucacuguguauaaugagcugacaaaggucaaauacguuaccgaaggcaugcggaagcccgcuuuucuuucaggggagcagaaaaaggccauuguggacuugcuguucaaaacuaaccgaaagguaacagugaagcagcucaaagaagauuauuucaagaaaaucgaguguuuugacagugucgaaaucagcggaguggaggacagauucaaugcaucccuggguaccuaccacgauuuacugaagauuauaaaagacaaggauuuucuugacaacgaggaaaaugaggauaucuuggaagacauuguucucacgcugacccuauucgaggauaaggaaaugaucgaggagaggcugaaaacauaugcccaucucuuugacgauaaggugaugaaacagcugaagcgccggcacuacacuggcugggggagacuuucuaggaaauugauuaacggaauccgcgacaagcaaagcggcaagaccauacuggauuucuuaaaaucagacgguuuugcuaaccgaaauuucauccagcucauucaugaugacagucugacauuuaaggaagccauccagaaagcacaggucuccgggcaaggccacagccuucacgagcagauugcgaaccuggcuggaucuccugccaucaagaaaggcauauugcagucagugaagguaguugacgaacucgugaaggucauggggcauaaaccagagaauauugugaucgaaauggcacgggagaaccagacuacccaaaagggacagaaaaauagucgugagagaaugaagaggauugaagaggguaucaaagaacugggcagccagauacuaaaggagcaccccgucgagaacacacagcugcaaaaugaaaaacucuaccuguauuaccuucagaacgggcgcgauauguauguggaccaggaguuggauaucaaucggcuguccgacuacgauguugaccauauugugccgcaaucuuucaucaaggaugacucgauugauaacaagguauuaaccagaagcgacaaaaauaggggaaaguccgaugacgucccuucagaagaggugguuaaaaagaugaaaaacuauuggcgacagcuccugaaugccaaacuuaucacucagcgcaaguuugacaaccugacgaaagcugaacggggcggucuaagugagcucgauaaggccggguucauaaaaagacagcugguggagacaaggcaaauuaccaagcacgucgcacagaucuuggacucucguaugaauacuaaauacgaugaaaacgacaagcugauccgcgaggugaagguaauuaccuuaaaaagcaagcucguguccgauuuucggaaagacuuccaguucuauaagguuagagaaaucaacaauuaccaccaugcucacgaugccuaccugaacgcggucgugggcacagcccuuauuaaaaaguaucccaagcuggagucagaauuuguguacggagacuauaaagucuacgauguuaggaagaugauagcuaaaagcgagcaggagaucggcaaggcaaccgccaaacgauucuuuuauucuaauauuaugaacuucuuuaagacugaaaucacauuggcuaauggggagauucggaagcgcccacucaucgaaacgaacgaggaaaccggagagauagugugggacaaagguagagauuucgccacugugaggaagguacuguccaugccucaagucaauaucgugaaaaagacagagguucagaccggcgcacuaacaaacgaaaguauuuacgcgcgggggagcuuugacaaacugaucucucgaaagcauagauucgaguccucaaaauauggaggcuuugguagucccacugugaccuacagcguccuugugguugccaagucgaaggugcaggaugggaaaguaaagaaaauuaagacgggcaaagaacucaucggaauaacccuguuggacaagcuggucuucgagaagaauccauuaaaauuuauugaggacaagggcuacgggaacgugcagaucgauaaaugcaucaagcuccccaaauauucccuguucgaguucgaaaauggaacacgcaggaugcuugcuucugugauggccaacaauaacagccguggcgaccugcaaaaggcaaaugaaauguuuuugccugcuaagcucgucacucugcuauaccacgcccauaaaauugagucaaguaaggaacuggagcacgaggcauauauacuugaucacuacaacgaccucuaucagcuguuguccuacaucgaacgguucgccucuuuauauguugauguggagaaaaacauuagcaagguaaaagaacuguuuuccaauaucgagucauacagcauuagugaaaucuguucuuccgugauaaaccuccugacccuuacagcuagcggugcgccagccgacuucaaguuucuggggacuaccaucccgagaaagagguacggaucgccccagucaauuuugucuaguacgcuaauccaucaauccauuacaggccuguaugagacccgcaucgaucucagccagcuggguucugacuga

SEQ ID NO: 3156 - RNA, 4119 nt, Artificial Sequence
  Cas9 variant
augaacaaugaguacuucgugggcuuugacaucgggaccaacagcgucggagccgcuguuacagaugaaaaguaucacgugcugaaauucaaggguaaugcaauguggacuuccgccguauuugagucugcgcagcaaucagcugacagaaggcucaaccggacggcccgccgacgucuugauagaagucagcagaggcgggaccuguugcaggaauuaauugcacccgccauaaccccuguggauccacgcuucuuugacagaaucagggagagcgcucugugggcagaagauaaaacaacuggcucccgguucaccuacuuuucugacgagggguauacagauaagcaauaccauaaagaguauccgaccauucaccaucuaaucugcucgcucaugaaugaccccgccccucacgauccacgccuggucuacauugcuuguucauauaugcuuacucaucgaggacacuuccugaacgaagccgacaaggagaagaucgaugacguguuggacauaagaaggguuuuuaaugaacucugcagcugguucacaaguuacggcaucgaggugcccuuuuccuguuucccugaggaauuugguaacguccugaccgcgaaucggggagugcaggaucguacgcgcgcauucuacgaccuccuguucgccggaaagaagccaaaacccucugaggaugaccagguagauauugacguuuuaaucaagcugauuagcggcggcaaaaucgaacuuuccaaguuguuucugaacgaggaauauucagagcuagagaauaacaagauacagcucagugaugcuggguucgacgaaaaagagccugaacugagaagcgagcuuggagaugacuuuggucugguggccgcagcuaagaauauuuacgauuggucuuugcucacuggcguccugggggaaugcaaauccaucucagaggccaaggugaaaaccuaugagaagcacagcgaagacuuagcggcccugaggcgggugguccgaaaauaccauccagacaaguauaaggagauuuucaaaaaguacguugugggaaacuauacaaguuacucuggcaauguaaaauccgcagguaagaucagcgaaacuaaacucaagcgcuguaaccaagcugaguuuugcgauuaccuuaagucgaaacugaaggacgugaaaccggcccccggggaugacgaaugugagagagucuugaaggagaucucuaaacacaccuucugcccuagacaggugacaaccgauaaccggguuauuccauaucagcuauacuauacggaacugaagaaggugcucgagaaugcuaaacgcuacauaccccagcugaacgucacugacgaauauggauccgccgcagauaagauccuuucacugaugacauuuaggauuccuuacuaugugggcccauugguuaaaaagaaugacaguagcaacgccuggaucguaaggcguggcgaggggcggauacuccccuggaauuucgaugagcugguggacaaagauaagugugaagacgaguuuauucgaagaaugaccugcaaguguacuuacaucgcugggaaaaacgucuuaccgaaaaauucccugcuauacugcaaauucauggugcucaacgaaaucaauaacauuaagaucaauggugagaggauuucugucggcgauaaacaaaagauauauacagaacuguuugagaaaaagcgcaaggugaccguucgggacaucagaaaccuuuugacgagcgaggggaggcugaaagcgggagacaccuucggcgguauugauaucacagugaagucaagucucaaaccucagcaugaccugaagcgccuuauggcagccgggguaaucacugaagcugaugccgaggaaauuauagagcgaauuaccugcacaacugacgucucccggcugcguaccugguugggcaaauuuggacucagcgcagccgaugcuaaguacgugucuggccugaaguauucagacuucgggagauuaaguagggaguuccugacagaaguuaaugauguggaccccgccaccggagaggucaucaacccaaauaucauuacuaugaugugggaaaacaacaucaaucuaauggagcuccugagccagaaauacuccuaucgcucucaaauagaaucgaugaaccgggaguacuaugcagcgaauccucuuacguuggaugaaagaaugagcgagauguacauccccuccgcugugaggcgaccaguaaagcgcacaauugagaugaugaaagaauacaugcacaucaugcggaagcccccuaaaagaauuuuuaucgagauggccagggaacugaccgaccucgauaacaaggguaagcguacuucaagucgccggaauacccuguuagaguucuuuaaaaaguguccacaggacacaaccgagcugagagcacagcuugagaaaaagucugaugacgaauugaggagcgaaaaacucuaucuguacuucgcccagcuaggcaagugcauguauuccggggagucaauagacauugaacgacugggaagcaagcucuacgauguggaccacaucuuuccgcaagcucggguuaaagaugacucuauugagaacaagguccuggugcuuuccgauuugaauggcgccaaaagugaccgcuaucccaucaacgcagauauaagaaauaagaugcauagcuucugggacaaacugcacucuaucgguuuaauuggggagaagaaauacgaaaggcucacucgguccacaggcuuuacggaugacgagcuggcuggauucaucucacgacagcuuguggaaaccagacagaguacuaaggccgucgcggcccuguuggcugaggaauuuccugagagcgagauuguuuaugugaaggcaggccucgccucgcaguuccgccaugaauuugggcugcuaaaauguagggagaucaacgaucugcaccaugcuaaggacgccuaccucaauauagugaugggaaacauuuaccacguaaaauucacaaaggacccaaugaauuuugucaaagaauaucgucggaaggagcaaguguucgaucugaagauccaguccaugcuuacccacgacgcaaucagaaacggugaaacagcguggauuggcgaugggacuugguuggagaccguuaaaaagcagauggagaaaaauaacaucagguacgugcgcuauucuuuccgaagaaagggagcccuguuuaacuuaaugcccgaacggaaaaauccuagccuccugccaaggaagaacggcaagaauaugguccuucccgcugagaaauacgguggguauaacaauacggccgcaucauucuuuagucuggugaaguaccauuccgcuaaaggcucuggaguugugauuauaccgguagaacuaauccacgcccaucgcuaugagcacgacagcuccuucgcagaggaauacgcccuccguguccuggcugauauugugucauugaagaaaggcgacgugcugcagagcgucgaguuuccuuuagggaguagaauccucaagguuaacacccugcuugauauugacggauuccgggcgaauaucacaggcaaggauucuggugggaaauaccugggaauauccagcgccucgucauugaucauuucucaaguggacacuaccuauaucaagaggguaauuaguaucaacgaacgcauauccgcaugcgagaaaaauaagcagagcuacacaauucgaccagaauuugaugugaucacuucugagagaaacaucgagauuuauaauaugcucugugagaaaauaagcucccggcccuucugcaucaaguuugcuaacaccucagacacguucgucaguggcagggaaaaguuuauugcccugagccuaaaugaacaggugaaaacacugaccaacaugcuuucuguuuucaagacuggucgcgccuccggcugugaucucacaaauaucgggggaaguaaaaacaccgcuauugugaagcugaacgcagucuugucaaaucugaaagacuucaagagcgugagaaucauagaccaguccccuacuggcuuauacgagaaaguuucucccaaccuccugucgcuuuga

SEQ ID NO: 3157 - RNA, 4119 nt, Artificial Sequence
  Cas9 variant
augaccaagaaaaacuacagcaucggccuggacauugggacaaauuccgugggaugggccgucauaacugaugacuauaagauccccgcuaaaaagaugaaaguucucgguaacacggauaaggaguacauuaagaaaaaucuucugggcgcauuguuauucgacucuggggaaaccgccgaggcgacaagacugaagaggacugcucggcgccgauauacccguagaaagaacaggcuacgguaccuccaggaaaucuuugccgaggaaauugcaaaggccgauaauucauucuuucaacgccuggacgagaguuuccuuacagaugacgauaaagacuuugauagccacccuaucuucggaaacaaggcugaggaagacgcauaucaucagaaguuuuccaccauauaccaccugagaaaauauuuggccgauucuccagagaagucggaccucaggcugguguaccuggcucucgcccauaugaucaaauaccggggccacuucuuaauugaaggugagcugaaggcggagaauacugacguacagaaacuuuuuacagauuucguggaagucuaugaccgcaccuuugaugacucacauuugagcgaggugacgguugaugcaaguuccauccugacugaaaagauuucuaaaagccgaagacuagagaaccucaucgaauccuacccgaaggagaagaaaaauacccuguucgggaaccuuauagcccugucauugggacuccagcccaauuuuaagacaaacuucaaacugagugaggacgcuaaguuacaauucagcaaagauacuuaugaagaggaccuggaagaggugcucgaaaagauuggcgaugacuacgccgaucuuuuuaccucugcaaagaaucuguaugacgcuaucuugcuauccggcauucugacagucgacgauucaagcaccaaagccccucucagugcgucuaugaucaagagguacgccgagcaccacgaggaccuggaaaaacuuaaggcauucaucaaaacgaacaagccaaaucuguaucaugauauuuuuaaggacgagacucagaacggguacgcuggauacauagaaaacggugugaaacaggaugaguucuauaaguacuugaaaacaauccucuccaagaccgacggcagcgaauauuuucuggauaaaauugagcgggaggacuucuuacguaagcagcgcacuuuugauaaugggucgaucccccaccaaauacaucugcaggaaaugcacgccauucuaagaaggcagggagacuacuauccuuuccucaaggagaaccaggaucggaucgagaaaauccugacauuucgaaucccauacuauguaggcccccuugcucgcaaaaauucuagauucgccugggcagaauaccacuccgacgagaaaauuaccccuuggaacuuuaauaagguuauugauaaagaaaagucagccgagaaauucauaacgaggaugaccuugaacgaccuguaccucccagaagagaaggugcugccgaagcauagucacgucuaugaaacauuugcuguguacaaugagcuuacuaaaaucaaguaugugaacgagcaagguaaagaagcguucuucgacagcaauaugaagcaggagauuuuugaucaugucuucaaagaaaaccggaagguuaccaaggagaaacuguugaauuaccucgacaaggaauuucccgaguaucgcauccaggaucugaucggguuagacaaagagaacaaguccuucaaugcaucucugggaacauaccacgaucuaaagaagauucucgacaagagcuuucuggaugacaaagugaacgaagagguaauagaagauaucauuaagacucuuaccuuguucgaggacagagaaaugauccaacagaggcugcauaaauauucagauauuuuuaguacacagcagcucaagaaacuggagcgucggcacuacaccggcuggggccgauuauccuacaagcugaucaaugggauaagaaacaaggagaacaauaaaacuauccuugaauauuugauugacgauggauacgccaacaggaauuucaugcaacucaucaacgacgacacgcugccuuuuaagcagauuaucaaagaugcucagauaauugguaauaucgacgauauugccgcagugguccacgagcuaccaggcagccccgccaucaagaaagggauacugcagucuaucaagauuguggacgaacucguuaaagugaugggacauaacccugauaauaucgucauugagauggcucgcgagaaccaaacaaccaaucggggcagaucacagagucagcagaggcugaagaaacuucaagacagcuugaaagaacuggguuccaacaucuuaaauaagaaaaagccaucuuauguggaggauaaaguagaaaacguucaccuccaggacgaucgccuguuccuuuacuauauacagaaugggaaggacauuuacacuggcgaggaacuggauaucgaccgauugucggacuaugauaucgaccauauuaucccccaggccuuuauuaaggaugacagcauagauaaccgggugcucaccuccucagcgaaaaaucguggaaagagugacgaugucccgaaccuggacaucgugagagcaaggaaagcugauuggguccgccuauacaagucuggccugauuagcaaacggaaguucgacaaccucacaaaguccgagagagggggacugaccgaggccgauaaagcagguuuuaucaagaggcaacuuguggaaacucgacagauuacaaaacacguugcccagaucuuggacgcucgcuucaauacggagcacgaugaagacgacaaggugauacggaacguaaaagucaucacccugaagucaaauuuaauuagccaauucagaaaggauuuuaaauucuacaaggugagggagaucaacgacuaucaucacgcccaugaugcauaccucaaugcuguugugggcacugcccugcuucguaaauauccuaagcuggcgcccgaauuugucuacggggaguauaaaaaguacgacgugcgcaagcuaauuacaucuuccagugauaaagccaccgcuaaguauuucuuuuacagcaaccucaugaauuucuuuaaacggguagugagauacucuaacggaaggguuaucguccgaccagugauagaguauuccaaggacacaggcgaaauuguguggaauaaagagacugauuuccggaccaucugcaagguccugucauacccucagguuaacaucgugaaaaagguggaaagucagacggguggguuuagcaaggagucgauuuugcccaaaggcgacuccgauaagcugauaccacgcaaaaccaagaaaguauauugggacacaaagaaguacggaggcuucgauucucccaucauugcauauagcgucuuugugguugccgacguggaaaaagggaaggcuaaaaagcucaaaaaggucaaggaguuagugggaaucucaauuauggagagaccuaguuucgagaaaaauccaaucguuuuccuggaaaagaaagguuacaggaacgugcaggaagauacucuuauaaagcugccgaaauauuccuuguuugaguucgagggcgggcggcgaagacuccuggccucugcaagcgaacuacaaaagggaaaugagguaguccuguccgaccgccuuguggaacuccuguaccacgcgcauagggugaacucauuuaauagcaccgagcacuugaaguacgucagugaacacaaaaaggaguucggcgagguucugucuuguguggaaaacuuugccaacuccuauguagacguggagaaaaauuuagauaagauccgugcugucauuaacaaaaucgacacauucagcauugaagagaucucgacuucauuugugaaucuccugacccuuacggcccugggugcacccgcugauuucaacuuuuuggggaagaaaauaccucggaagagauacacaucuaccaaggaaugccucaaugccacucugauucaucagaguaucacaggccuauaugagaccaggaucgaccuguccaaacuuggagaggauaaguga

SEQ ID NO: 3158 - RNA, 4119 nt, Artificial Sequence
  Cas9 variant
augaccaagaaaaacuacagcaucggccuggacauugggacaaauuccgugggaugggccgucauaacugaugacuauaagguucccgcuaaaaagaugaaagugcucgguaacacggauaagaaguacaucaaaaagaaucuucugggcgcauuguuauucgacucuggggagaccgccgaagcgacaagacugaaaaggacugcucggcgccgauauacccguagaaagaacaggcuacgguaccuccaggagauuuuugccaaugaaaucgcaaaaguagaugagucauucuuucaacgccuggacgaaaguuuccuuacagaugacgauaagaccuuugacagccacccuauuuucggaaacaaggccgaggaggaugcuuaucaucagaaauuuccaacuaucuaccaccugagaaagcauuuggcagacuccucugaaaaagccgaucucaggcugguguaucuggcucucgcccacaugauaaaguuccggggccacuuuuuaaucgagggugaacugaaugcggagaacacagacguccagaaaauuuucgcagacuuuguggggguuuacaaucgcaccuucgaugacucgcaccuuucagagaucacgguggaugucgccagcauuuugacugaaaagaucaguaaaucccgaagacuggagaaccuaauaaaguacuauccgaccgaaaagaaaaauacacucuuuggaaaccugauugcucuugcccugggcuugcagcccaauuucaagacuaacuucaaacucucugaggacgcaaagcugcaauuuagcaaagauaccuacgaagaggacuuagaggaacugcucggcaagaucggggaugacuaugcugaucuuuucacauccgccaagaaucuguacgacgcgauuuugcuaucaggaauccugaccguggaugacaacaguacgaaagccccucucagcgcaucuaugaucaagagguauguagagcaccaugaagaccuggagaaacuuaaggaauuuauuaaagcuaacaaguccgagcuguaccacgauauauucaaggacaaaaauaagaacgguuaugccggcuacaucgagaaugggguuaaacaggaugaauuuuacaaguauuugaaaaacauucucucaaagaucaagauagacggaagcgauuacuuccuggacaaaauugagcgggaagacuuuuuacguaagcagcgcacuuucgauaauggcaguaucccacaucagauccaucugcaagagaugcacgcuauucuaagaaggcagggugauuauuaccccuuucucaaagaaaagcaggaccggaucgagaaaauucugacauuccgaauaccuuauuacguggggccacuuguccgcaaggauucuagauuugccugggcagaguauagguccgacgaaaagaucacccccuggaacuucgauaaagugauugacaaggagaaaagcgccgaaaaguuuaucacucggaugacauugaaugaccuguaccucccugaggagaaagugcugccaaagcauucgcacgucuacgaaaccuaugcuguuuacaacgagcuuacgaaaaucaaguaugugaaugaacagggaaaggagucuuucuucgauuccaacaugaaacaagaaauuuuugaccauguauucaaggagaaucgcaaagugaccaaggagaaacuguugaacuaccucaauaaggaauuuccggaguauagaauaaaggaucugaucggcuuagacaaagaaaacaagucauucaaugcgagucugggcacauaccacgaucuuaaaaagauucucgacaaagcauuucuggaugacaaggucaacgaggaagugaucgaggauauuaucaagacucuuaccuuguucgaggacaaagauaugauacaugaaaggcugcagaaguauagcgacaucuuuacagccaaccagcucaaaaagcuggagcgucggcacuacacuggguggggacgauuauccuacaaacugauuaaugguaucagaaacaaggaaaauaacaaaaccauucuugauuauuugaucgacgacggcucugcuaauaggaacuucaugcaacucauaaaugaugacacacugcccuuuaagcagauuauccaaaagagccagguugugggggaugucgacgauauugaggccgugguacacgaccuaccuggaucaccagcaaucaaaaagggcauacugcagaguguuaaaaucguggaugaacucgucaaggugaugggugggaaccccgacaauauugucaucgagauggcccgcgagaaccagaccacuaaucggggcagaucccagagccagcaaaggcugaaaaagcuacagaacucuuugaaggaacugggaucaaauauuuuaaacgaggaaaaaccuaguuacaucgaggauaagguggagaauagccaucuccagaacgaccagcuguuccuuuauuacauacaaaacggcaaagauauguauacgggggacgaacuggacauugaucacuuguccgacuacgauaucgaccauaucauuccacaggcuuuuaucaaggaugacucuauugauaaucgcguucucacaucgagcgccaaaaaccgaggaaaguccgacgaugugcccucacuggacauaguacgggcacguaaggcggagugggucagacuauauaaaaguggucugaucucuaagaggaaauucgauaaucucaccaaggcugaacgcggcgggcugacugaggccgacaaagcaggauuuauuaagcggcagcuuguggaaaccagacagaucacaaagcacguugcccaaauuuuggaugcuagguucaacaccgagcacgacgagaaugacaaagugauccgagaugucaaggugauaacucugaaaagcaacuuaguaucccaguuccgcaaggacuuugaguucuacaaagugcgggaaaucaaugauuaccaucacgcccaugacgcauaucucaacgcuguugucggcacagcccugcuuaagaaguacccgaaacuggcgucagaauuuguguauggugaguacaagaaauaugauauuagaaaguucaucacgaauagcucugacaaagccaccgcuaaguacuuuuucuauuccaaccuaaugaacuuuuucaaaacuaaggugaaguacgcagaugggacagucuuugaaaggccuauuaucgagaccaaugccgacggcgagauagcuuggaauaaacagauugauuucgaaaagguucguaaagugcucaguuacccccaagugaacaucguaaagaaagucgagacacagacuggaggcuuuagcaaggaaucuauccugccaaagggggacuccgauaaauugauuccucgcaagaccaaaaagguguauugggacacgaaaaaguacggagguuucgauucacccaccguugccuauaguguguucgucguggcagacguugagaagggcaaagcgaagaaacugaagacagugaaagaauuaguagggauaagcaucauggagcggucguuuuucgaggaaaauccagucgaguuucucgaaaacaagggauaccacaacauuagagaggacaagcugaucaaacuucccaaguauucccuguucgaguuugaaggcgguaggcgacgguugcucgccucugcuagcgagcugcagaaagggaaugaaauggugcuaccuggcuaccugguggagcuucucuaucaugcccaccgcgcagauaacuucaauucaacugaauaccugaacuacgucagugagcacaagaaagaguuugaaaagguuuuguccugcguggaggacuucgcuaaucuguauguagauguggagaaaaacuuaucuaagauuagagccgucgcagacagcauggauaauuuuuccaucgaagaaauaucaaacagcuucaucaaucuccugacccuuacagcccugggagcuccagcggacuuuaacuucuugggcgagaagauuccgaggaaacgguacaccaguacuaaggagugucucaaugccacgcugauccaucagucuauuacagggcuauaugaaacccgaaucgaucuguccaaacuuggagaggaauga

SEQ ID NO: 3159 - RNA, 4119 nt, Artificial Sequence
  Cas9 variant
augaacagcgacaagagagaggauuacuaugugggccuggacauggggaccggaucccucgguggcgccgucacagauacucaguaccaccuucugaaaguuaaggggaaagacuucugguuugugagggaauaugagacggcuaagucucaauuggaucggcgcacccaucgaaucgcaaaacguagauuacagaggcacaaggcccggauuggacugauacgcucauacuucgcggaagacauccuaaagcaugauccccucuuuuauauuagacaggacaauaguaaauacuaucacgaggauaaggacguaaggcugacaacuaaagauagcaucuucgcugacccuggcuacggugauaaggaauaccuugacgacaaagaguauccaaccauuuuucaucugcggcaggccuugcuccgcgaucaaaucaaggacgaggaacgauacuccagauuccuguaucuggcaauaaucaacauguuugagcacagggggcacuuccucuuaaauacagaaucuucggaucugaacgccgacaugauuaaggaugugggagagcuugucaugaaugcuaucugcggcgugucagaguacggcagcguuaccuauaaagaaauuaucgagauauuggaagacaagaacauuagucggacugccaaaaaggaucagaucgcauccaaaauugacaucaagaaaucugagaaggcucagauggaacguaucaagugucugugcgggauggaggccgaugcgcgcgugauguuugagauugaagcagacgagaaaauaaagaucgccuuccagcaagcugccuuugaagaugagaaagaagagauugaggcagucaucggagaagacagauaccuaauaauugagaauaugaagcagcucuaugacuacagccagcugcaguccgugcuuaacgguuucgauuaccugucagacgcuaggguacaaauguaugaaaaacauaaggaggauuugcaccuccugaagaaaguuuaccggaagaauuuagaccgagaaaucuaugaucgcauguuuagaaguggcgaggaggggagcuacugugccuauucuaacuccacaaauucaguggacagccuggcggaagccaaaaaguacaggcggaacaugaaaaagcgcagucagaaggaucucuaugacagaaucaaaaaggaucuuaaagagguccaugacgcagaugcugacgccauuaggaaggaaauggagcuggagcguuucuugccgaaacagaucaccggagcuaauggcauuauacccaaccaagugcaccggaaggaacuaaagaaaauccuggagaaugccgaacaccaucucgauuuccugaaggagaaagacgaaucugguuacacgguguccgagcgaauuuugaugcuguuuagcucgaacaucccuuacuaugucgggccaguuggaucuggcuccaagacuggcugggcaaaaauccaggagucaggacagguguugcccuggaacauggaacagaagauugacauagagcaaaccagugaaagauucaucacaaaucucauuagggagugcacuuaccugagcggggaaaaaguauuaccuaagcagucccugcuauaugagucuuacugugugcucaacgagaucaauaaccugcgcauucacgguaagcggaucgucccagaacuuaaacaggauauauauaaggagguguuucagggcuucagauuggggaaaaagguuaccaaaaagaauaucugcacauaccugauuaacaggggacucaucaccgaagagagcgaagugucaggcauugacaaggagaucaaugccuaucugcccaguuacgguaaaauguacggggucuuuggcgagcgccuucgagaagaggcugugcaagaaauagcggagaagauuaucuauuacggaacgauuuauggcgaugcaaaauccauguuccggaagaaacugaaccaguacguaagcgacggguggaugacugaguaucaggccaagcguaucucuggauacaaguuuaaagauugggcuagauugucaaggaguaugcucugucugagcgguugcgacaaguccacaggcgagaaaauaucuuuaauccgcgccaugugggaauauaaucugaacuucauggaacuaauuuaccgggaggauuuuaccuuccagaaggaacucgaggagagaaggaaagcacuggggaagacucuucaagaauuucaguucgaggacuuggaugaauacuauuacucggccccuguuaagcgaaugaucuggcaggcugugcaggcccugaaagagauuacacaaaucaugggacauaauccaaagcgcauauuuauugaaaugacccggacggaggaggaaaaaggcgagcaggguagaaagaacagcagggaaaaacgucuccugaagauguaugaguccauccgcgacgaacggaauugggcagcggagaucaaaaacgcuaaugccucagggaaguuaaacaguaagaaacuguaccuuuauuacuugcagaugggcagagaugucuauaccggagagccgauugacaucgaagaucucuucgacgacucuagguacgauauugaccacauauacccccgaagccugacaaacgauaauaacaucgagaauaaccuagugcuggucuccaagacuauuaaucaaaacgaaaagaaaaaugacuauccugugccagagaaaauccggcgcaacaagaagguuagaaaucucuggcauacccugcacaaaaugggcuucaugaacgaugagaaguacaauaggcuuacaucaacugaacgguugagcgaggaccagcuggcaggguuuauugcccgacaguuaguggaaaccgcucagggagccaaagguaucgcagagcucaugaaggcuaugcugcccggcacagauauaguauaugccaaagcgagaaacgucucugacuuccgcaaggaauacaagaugcuuaaauccaggcuggugaaugauuaucaccaugcccaagacgcuuacuugaacaucguuguggggaaugucuauuuuaugaaguucacccguaacccuaugaacuuugugaaaacugaggcacggagagauggaaggaauuacgacuacaaccucuauaagauguacaguaaagacauuauccgcaauggcgagaaggccuggauugcuacgagcgaacaggguccagggacaauccgacugguaaaggagaccaugggcagaaacacucccauaauuacccggcaggccuucgaacagaggggagagcuauuuaaucugcaaccggugggcaaauauucugcaaagaaagauaacuacguuccucucaagaucaaugacgagaaaaugcaggaugucuccaaguaugggggauacacaucacugaaccccaguuauuucaucuuuauugaacacggcccagagaagaaacgcaagaaauguuucgaagugauacauagcuacuacgcggcccagaucaagaccgagaaagaccuuauugauuuucuucugcagaaggguuauaaaaauccucgugugaucaacgcuagaauuaagaagaaugccuuaaucaaauacaacggguauuuccucuacauaaucggaauggacgcacggaagaauauugaauuuucgaacgcuacugccaugugccugaaaaauaaguauauccaauacgucuguaaacuugagaagaugaacaaggcaauucugcuauccgaaaaacagaagacaaaccuccacugggaugagaaaaucacgugcgagucuaaucuggaauuguauagggagcugaccgaaaagcacuuacauagcauauaccagcgccacccccgaucaauuggcaaaugccucgccgacggugagggcgcuuucaagcugcuugauaucgaggaacaaguuaagaucauuugugacaucgugcaguacacaaguuuccagagagggguguuuucccugaaaguauugggaggcccaaaggaggucgggcggauaaggauuucuggaaacaugacugaagcgaaagagugcaagcucgugaauuauagcaucaccggcauguacaaaacagaaauggaucugcuaaagaaguga

SEQ ID NO: 3160 - RNA, 4122 nt, Artificial Sequence
  Cas9 variant
auggagaagaccuacagcaucggccuggacauugggacaaacuccgugggauggucugucauaacugaugacuauaaaguucccgccaagaaaaugaaggugcucgguaauacggauaaaaaguacaucaagaaaaaccuucugggcgcuuuguuauucgacucaggggaaaccgcagagguaacaagacugaagaggacugcccggcgccgauauacccguagaaagaauaggcuacgguaccuccaggaaauuuuugcgaaggagauggcuaaaguggaugaaaguuucuuucaacgccuggaggagagcuuccuuacagacgaugacaagaccuuugauucccacccuaucuucggaaacaaggccgaagaggacgcauaucaucaggaauuuccaacuauuuaccaccugagaaaacauuuggccgauucuucggagaaggcugaccucaggcuggucuaucuggcacucgcccacaugaucaaauuccggggccacuuuuuaauagagggugaacugaaugcugagaacacagauauccagaaguuguucaaugacuuuguggaaaccuacgacaaaauugccgaugagucacauuugagcgaaguugacgcgaguuccauccugacgaacaagauuucuaaaagccgccgacuagagaaucucaucaagcaguacccgacugagaagaaaaacacccuguucgggaaucuuguggcacuggucuugggacuccaacccaacuuuaagacaaauuucaaacuguccgaagaugccaaguuacaguucucaaaagacacuuaugaugaggaccuggaggaacuccuuggcaagauaggcgaugacuacgcugaucuguuuaccgccgcaaagaacuuguaugacgcuauucuacugagugggauccucacaguggaugacaauagcaccaaagccccucugucugcguccaugauuaagagauacgaggaacaccaugaggaccuugaaaaacugaagaaauucaucaagguaaacaacuuugauaaguaucacgagaucuucaaagacaagucaaagaauggauacgccgguuauauugaaaacggcguuaagcaggauauauuuuacaaacaucuuaagagcaucauuagugagaagaaugggggacaguacuuccucgacaaaaucgaaagggaggauuuucugcggaagcaacguacguucgacaacggcucuauaccacaccagauucacuuacaggagaugcgcgcaauccugagaaggcagggugaauauuaccccuuucuaaaagagaaucaagcuaagaucgaaaagauucucacuuuccggaucccuuauuacguggggccacuggcccgaaaggauucccgcuuugcuugggccaacuaucauagcgacgagcccauuacaccuuggaauuucgaugaggucguggacaaagaaaagucggcagagaaguuuauaaccagaaugacucuuaacgauuuguaccugccagaagagaaagugcucccgaagcacucucaugucuaugaaacauucaccguuuacaaugagcugacgaaaaucaaguacgugaacgagcagggagaauccuucuuuuucgacgccaauaugaaacaggagauuuuugaucacguauucaaggaaaacaggaaggugaccaaagcuaaacuucugucauauuugaauaacgaguuugaagaguuccggaucaaugaccucaucggccuggacaaagauaguaagagcuuuaacgcguccuuaggcacauaccaugaccugaaaaagauucuagauaagucuuuccucgacgauaaaacuaacgagcaaauaaucgaagacauuguccugacccuuacauuguuugaggaucgcgacaugauccacgaaagacugcagaaguauagcgauuucuuuacuucacagcagcucaaaaagcuggagaggcgucacuacaccggguggggacgguuaaguuauaaacugauuaaugguauccgaaacaaggaaaauaacaagacaauacuugacuucuugaucgaugacggccaugcaaauagaaacuuuaugcaacucauuaaugaugagucccugagcuucaaaaccaucauucaggaggcccaggugguuggggacguggacgauaucgaagcugucgugcacgaccuacccggaucuccugccauaaagaaaggcauucugcagucaguaaagaucguugaugagcucgugaaagucaugggugacaacccagauaauauugugaucgaaauggcaagggagaaccaaacuacgaaucgcgagcggagucagagccagcagagacugaagaaacuucaaaacuccuugaaggaacuggggucuaauauauuaaacgaggaaaagcccucguacaucgaggacaaagucgaaaauagccaucuccagaacgaucagcuguuccuuuauuacauucagaacggcaaggacauguacacaggagaugagcuggacaucgaucacuuguccgacuaugacauugaucacaucauaccucaagccuuuauuaaagacaauucaaucgauaacagggugcucaccaguucugcuaagaaucgcggcaaaagcgacgauguuccaucccuggacaucgugcgagcccggaaggcagaguggguacgucuauacaagucagggcugauuagcaaaagaaaguucgauaaccucacuaaagcggaaaggggaggucugaccgaggcugacaaggccggcuuuaucaaacgccagcuugucgaaacacggcagauuaccaagcauguggcacaaauauuggaugccagauucaauacuaagagggacgagaacgauaaaguuauccgagacgugaaggucauuacacugaaaucuaauuuagugucccaguuucgcaaggaguucaaauuuuauaagguacgggaaaucaacgauuaccaccaugcucacgacgccuaucucaaugcagugguugggacggcucugcuuaagaaauaccccaagcugaccccggaguucgucuauggagaauacaaaaaguacgacgugagaaaacuaauugccaagaguagcgaugacuauucugagaugggcaaggcgacugccaaauacuuuuucuauuccaaccucaugaacuuuuucaagacagaagugaaauacgcugaugguagggucuucgagcguccugacaucgaaaccaaugcagauggggagguuguguggaauaagcagaaagacuuugauauagugcgcaagguacugucauauccccaggucaacaucgugaaaaagguugaggaacaaacagugggccagaauggaggcuuguucgacaacaacauucuggccaagccagagaaagaugacaagaaaaaguuauuuccuaucaaaaagagucucagcacuaccucguacgggggauaugcucgggccacgauugcauacuccauccugauagucucugaguucgguaagaauaaagaacuuaagcuguugggccucccccugcuagauaaagugaaguacgagaaaaacccaauugcguaucugaauagcaucgggaucauuaacguuaagucaauauuuaaacuucccaaauacugccucuucgaauuucaggagaagaauaccaacuauagaagguacauggugaguaaucaggaacugaaacgagccaaccaauuguuccugacauguaaggagacugaauuaguauauaaauacaucaaguccgacaaugauaacacccaucucgucggaaaugagaagacaauucugucuaucuggaacaaacuugugauuuuuauggagcggacuaagcugaucgacaaaaaguuguucgcuagccucaaacagcugaaggacgaaguggaucuaauaaauauccuggacaugaccgccaaaucccuugauuuuacgaagauuucagcaggccagaagaaaaucacaauuagcgacagucucucucugccuaucaagcgcuggcaguucuccagcgaugagaaaauguugaagcaauuaaaaaccgcuacucugauacaccagucggucacaggucucuaugaaaccagaauugaccugucaaaacuuggggaggaauga

SEQ ID NO: 3161 - RNA, 4122 nt, Artificial Sequence
  Cas9 variant
auggagaagaccuacagcaucggccuggacauugggacaaacuccgugggauggucugucauaacugaugacuauaaaguucccgccaagaaaaugaaggugcucgguaauacggauaaaaaguacaucaagaaaaaccuucugggcgcuuuguuauucgacucaggggaaaccgcagagguaacaagacugaagaggacugcccggcgccgauauacccguagaaagaauaggcuacgguaccuccaggaaauuuuugcgaaggagauggcuaaaguggaugaaaguuucuuucaacgccuggaggagagcuuccuuacagacgaugacaagaccuuugauucccacccuaucuucggaaacaaggccgaagaggacgcauaucaucaggaauuuccaacuauuuaccaccugagaaaacauuuggccgauucuucggagaaggcugaccucaggcuggucuaucuggcacucgcccacaugaucaaauuccggggccacuuuuuaauagagggugaacugaaugcugagaacacagauauccagaaacuuuucaaugacuuuguggaaaccuacgacaaaauugccgaugagucacacuugagcgaaguugacgcgaguuccauccugacgaacaagauuucuaaaagccgccgacuagagaaucucaucaagcaguacccgacugagaagaaaaacacccuguucgggaaucuuguggcacuggucuugggacuccaacccaacuuuaagacaaauuucaaacuguccgaagaugccaaguuacaguucucaaaagacacuuaugaugaggaccuggaggaacuccuuggcaagauaggcgaugacuacgcugaucuguuuaccgccgcaaagaacuuguaugacgcuauucuacugagugggauccucacaguggaugacaauagcaccaaagccccucugucugcguccaugauuaagagauacgaggaacaccaugaggaccuugaaaaacugaagaaauucaucaagguaaacaacuuugauaaguaucacgagaucuucaaagacaagagcaaaaauggauacgccgguuauauugaaaacggcguuaagcaggauauauuuuacaaacaucucaagagcaucauuagugagaagaaugggggacaguacuuccucgacaaaaucgaaagggaggauuuucugcggaagcaacguacguucgacaacggcucuauaccacaccagauucacuuacaggagaugcgcgcaauccugagaaggcagggugaauauuaccccuuucuaaaagagaaucaauccaagaucgaaaagauucucacuuuccggaucccuuauuacguggggccacuggcucgaaagaacagccgcuuugccugggcuaaauaucauucggaugagcccauuacaccuuggaauuucgacgaggucguggauaaggaaaagucugccgagaaauuuauaaccagaaugacucuuaacgacuuguaccugccagaagagaaggugcucccgaaacacucccaugucuaugaaacauacgcaguuuacaaugagcugaccaagaucaaauaugugaacgagcagggaaaggaaucauucuucgauaguaauaugaagcaggagauuuuugaccacguauucaaagaaaacaggaaggugacgaaagagaaacuucugaauuacuugaacaaagaauuucccgaguaucggaucaaggaucucaucggccuggacaaggagaauaaaucauucaacgccuccuuaggcaccuaccaugaccugaagaaaauucuagauaagucuuuucucgacgauaaagucaacgaagaggugauagaagacaucauuaagacacugacucuuuucgaggauaaggacaugauccacgaacgcuugcaaaaauauagcgauauuuuuaccgcuaaucagcugaagaaacucgagagaaggcacuacacaggguggggacgucugucauauaaguuaaucaacgguauacggaauaaagagaacaauaagacuauccuggacuaccuuauugaugacggcagugcgaaccgaaauuucaugcaguugaucaacgaugacacccucccuuuuaaacagauuauccaaaagucccagguugugggggaugucgacgacauagaagcagugguacaugaucugccaggaagccccgccauuaagaaaggcauccuacagucuguuaagauuguggacgagcuggucaaagugaugggugggaauccugauaacaucgucauagaaauggcuagagagaaucagacaaccaacaggggccgcucacaaagucagcagcggcucaagaaacugcagagcucccuuaaggaguugggaucuaauaucauuaacgaagagaagccaucguacaucgaagacaaaguggagaauagccaucugcaaaacgaucaguuauuccucuauuacauucagaacggcaaggacauguauacuggggaugaacuggacaucgaucaucuuuccgacuacgauauagaccacauuaucccccaggccuuuaucaaagacgauucaauugacaauagaguucugacgaguucugcaaagaacaggggaaaaagcgaugacgugccguccuuggauaucguacgcgcccgaaaggcugaguggguccggcucuauaagucaggucugauuagcaaacguaaguucgacaaucuaacaaaagccgagagaggcgggcugaccgaagcagauaaggcgggauuuauaaaaaggcaacucguggagacucgccagaucaccaagcacguugcucagauucuggacgcccgguucaacacagaacaugaugagaaugacaaggugaucagagaugucaaagugauuacccuuaagucuaacuugguaucccaauucaggaaagacuuugaguucuacaaggugcgagaaaucaaugauuaucaccaugcacacgacgccuaccugaacgcuguugucggcacugccuuacucaaaaaguacccuaagcuggcacccgaguuuguguauggugaauacaaaaaguaugacgugcgcaaacuuauagcuaagaguagcgaugaccauucugagauggggaaagccacagcgaaguacuucuuuuauuccaaucugaugaacuucuuuaaaacgaaggucaaguacgccgauggcucaguuuaugaacggccaaucauugagaccaaugcugacggagaagugguguggaacaaacagaaggauuucgagaucauuagaaaaguacuaaguuacccucaggucaauaucgugaagaaaguugaggaacagacugugggccaaaacgggggacucuuugacaauaacauacuggcaaagcccgagaaggaugacaaaaagaaauuguucccaauuaagaaaagccugucgacaaccuccuacgguggcuaugccagggcuacaaucgccuacucuaucuuaauugucagcgaauuugggaagaacaaggagcucaaacugcuuggacugcccuugcucgauaaggugaaauaugagaagaauccuauagcauaccugaacucaaucggcauuaucaauguuaaaaguauuuucaagcuaccaaaguauugccuguucgaauuucaggagaaaaacacuaauuaccgucgcuauaugguguccaaccaggaacuuaagcgggcgaaucaguuguuccugaccuguaaagagacggaauugguauacaaguacaucaaaucugacaacgauaauacccaccuggucgguaacgagaagacaauauuaagcaucuggaauaaacucgugauuuuuauggagagaacuaagcugaucgacaagaaacuuuucgccucccugaagcaauugaaagaugaagugaaccucauuaauauccuggacauagcuucaaagagcauugacuuuaccaaaaucagugccgggcagaagaagaucguccuaaacgauucucugucccuuccgauuaaaagguggcaguucaagagcgacgagaaaaugcucaagcagcugaaugaugcaacauugauccaccaaucgauaacuggcuuauaugaaacccgaauugaccugucaaaacucggagaggaauga

SEQ ID NO: 3162 - RNA, 4122 nt, Artificial Sequence
  Cas9 variant
augaaccugagaagggcccgggacuacagcaucggccucgaucuugggaccggauccguggguugggcugucacagacgcagagggcaaucuguauucuuucaaggggcgccccgccaugggaucacgaacuuuuccuaacgcggaaccagcuaguguugcccguauuccgagaggccagaggcggcgcuacgagagaaggcggcaacgcauaaaauuguuacagcaguucuuuaugagcgauauggaacgaguggaccccgauuucuuuacgagacugaaucaguccacccuacucgcagaggacaaggaugaaaggaucgccucuugcgcuuggccuauuuucaacucgucagacuuuacagagaaagauuauuacaagaaauucccaacuaucuaucaccuucgggcauuucuuugugagagcgacgaaaagggugaucugcguuugguauaccucgcccugcauaauauugugaagcaccgcgggaacuuccuguaucaagacaaucccgcucucagugccuccgaugcgucugucgacgaggcagugagacaguuaguugacgcccuggcugaauggugccagaacaaagagaucgagcuuagcugugaugccggaaggauaaucgaaguguuuggcgacgcauccuugcggcgaaccgauaagcgcgaccagcugaaaggccuacucgggcugccugcugaucuugccaagacaaugggaaaagagcuggcgucagccgucuuggguuacgcagcuaauuucaguaagauuuuucucaucagcgacgccgaacauaaguucucucugggcaacgaugagaaaguggaagaguucgagaccauuugcccaaaugaauguacuuccuuauuuucagcucugagaacagccuacagcgcauaucuccuuagugggauccugagggacgccaacggaaagaccuugucuuucugcaaaaagaaagaguacgaucgguaucacgacgaucuagcucugcucaaggcgcugguacgcgaauacgcacccgaguccuaucagagcuuuuucggcggugaaagacuuguugugaaugggaggaugacgaaacguuacgacccuacuaaggccaagggauauaccaaauacgaccugguccauucggcuggcucuuacgaugaguuggccaaggacgugaaaaagcuccugggcuccuuagcagccgaugacucacgguaucaacgaaugaugcaggcuuuugaugaggaaagauuccugaggcgccuaaaaacaagugacaacgggagcauaccauaccagcuccaccuggaggaacuucgggccauuaucgcaagacaaggagaguuuuauccguucuugaaggaagaguccaagaaaauugagucucuggugagcuuuaggauccccuacuaugucgguccucucacuaccaagaaugcggcuguugaugugcacggcaacaaacgcuucgccuggucagaacgaaagccagggauggagagugcaaaaguacggcccuggaacugggacgaugugaucgaccguggaaaguccgccgaaaauuuuauugucagaaugacaggcaccuguacguaccugcagaacgagaaggugcuuccuaaaugcagccuguuguaugaggaguucuguguucucaaugagcugaacggugcucauuggucugccgauggggaccacgaaugcccauuugauacuucagacaggcgcggcauagugcaggacuuauucuguggaaagcggagagucaguuacaaacaaguggaggauuggcugaggcagcauggcagccgacgcgcacggguauccgggggacagggugcuucuggcuucgaaucgaagaugagcuccuacaucuuuuucucaaaagacguucuacacguggauagaauugaccccgccgauuuuccgaugaucgaggagauaauucucuggaauacacuguucgaagacagggauauccuuaaggagcguaucgaagaggcguauggggaccgcuugaacgccgaacagauuaagaccaucugcaaaaagcgguuuacuggauggggcagacugaguaggcgacuccugacagguauuaaagcucaaaccgaucagggggacuuaucuauaauggauauccugcgggagggcgacccuaauaacgaucaccgcggaaaggcaauggucuucaugggcauucuucauagcgaggacuugggguuucagaaaaagaucgaccagaucaaucaagaaaaaguguccgccggaaaggucucacucgaggaucugcccgguagcccagcucuaagaaggucuauuaaccaggccaugcgggugguugacgaaauaguguccaucgcaaagugcccucccagucacauuuaccuggagguaacgcgagaugaagacggcgcgagaaaagggcgcaggagcacccgucgguaugaugccaucaaggcugcccucgagaaauucaaggaggaaucuccaacaugguuugaccaggaugucuucggagaguuuagaaggucccgcgcagaagaccuggaugagcgacuuucauuguacuucaugcagggcgguaaaagucuguauagcgcuacucccuuaaagcucgagcugcuucauaccaaucaauaccagguggaccacauuaucccucagucguauauaaaggaugacuccuuugaaaacaaagcccugguuuuggcaggggagaaucagagaaagucugacgcccuccugaucgauagcucaauucggacagcuauggcgccauacuggagggcccuacaucaagcaggccugaugggagacaaaaaguucaacagucucauguguuccucuaucagcgauaaacgcgugcguggcuucauugcuagacagcuggucgaaacuucccagaucgugaaacuugccgggaugauguugcaaucaaauuacccggaggccgacguacagcccgugaaggcuagccugggacacgauuuacggguucaggcaggcuuuauaaaaugcagggaagucaacgacuuccaccaugcccacgaugcgcucauugcuugugaggugggucgcuauaucaaccagugccauccugggauuuacgacaauccaaucggauaugcccgagcagugagagagcugguccggaagcaaaacgaagagaugaggaaauacggccgccuucccgguagugccggcuuuauaguugggggauucaugagaacccacguggauguggacacaggcgaaguagucugggaugcugaggaagaacugucuaggauccgggcauaucuagacuacuccaauguguuuguuacccguaugagcgaggaaacuucgggggcccucuggaacgcgacgauuuauucaccucacuacggaaagacagcuccaacccugcauaucaaacagggcuuggaugugcagcgcuacgguggguauucuagugccacuuucgcauacuuuacccuguaugucgccgagaagggaaagaaacgaaaggcugaauuacucggcauucccaucuccguggccagaaaaauagagggugaaccgagcaagcuggacgcauucguugcucaggacgccgaggcgaaaaagcugaaacacccucugauuaucagggcccggaucuugaaguacgcacgcuuugagauggaaggcaaucaauucuauuuugcugcccaggaugcuguguacucugcaagacagcucguacugaagggggaccuauauagcgucgccgccaaggcuugugauaagcaucugaacgacuccugcauuucaaaugaggaucuuaucaggcucuacgacgaacuggugcacaaaggagauuugcuguguaacaaguucggcaaugugacagacgucuuacgggcggggcgagagagauacgcaggacucaguauuagcgagaaacgccagcugguuugcaacgugcuugccuauuacaggucugcuaccgcccggguagauauaucccuggugggcgguccaaagcaugcagggaauuugggaaucgccuucguccucaacaaucccgaagcuauuguguuuguugaccaaucagugacuggcauguucgagaagcguacaagagucgaacuguga

SEQ ID NO: 3163 - RNA, 4122 nt, Artificial Sequence
  Cas9 variant
augaagaaaauccugggccucgaccuugggaccaacagcauuggaugggcccuggugaaugaggcugauaacgaaagagagaaguccucuauaaucaaaauuggugucaggguuaaucccuugacaguggacgaacagcaaaacuucgagaagggcaaaucaaucacuacgaaugcagaucggaccuuaaagcgcaguaugcgacguaaccugcagagauuuaagcuaaggaaagaaaaucucauugagauccugaagaaacagaaguucauaaacgacgagacaauccuuagcgaaaaugggaacaaauccacuuuugagaccuacaaucugcgggccaagucugcgacagaagagauuaccuuggagcaguucgcucgcguacuccugaugaucaacaagaaaagaggauauaagucgucaaggaaagccaagagccaagaugaaggccagcugauugacgguauggagaucgccaaaaagcucuacaaugauaacuuaacuccugggcaguuuguguuccagauacugaaagaaggaaagaaguauauuccagacuuuuaccggagugaucuucaagcagaguucgacaaaaucugguccuuucagaagcaguucaauccggauauuuugacagaagaguuuaacaaacagaucaucggcaagggcaaagucaacaccacgaagauuuuccuggcuaaguaugggauauacacuaucgacaauaaaggagcagauaagaaaucucaagccuauaacuggcgcguggaggcucuaaccaaucagcucacaaaggaagaacuggccuuuguuauuagcgaccuuaacgguaucauauccaauucaaguggcuaccuggggagcauuucugaccgauccaaagaauuguacuucaacaagcagacugugggacaauaucucaucgcgcagcugaaggagaauccccacacccagcugaaaaaccaggucuucuacagacaagauuauuuagacgaauuuaauacaaucugggagacccaggcaaaguuccauaaagagcucacgaacgaacuuaaggaggaaauuagggauaucauuauauuuuaccagcggaaacugaagucacagaagggcuugaucagcuucugcgaguuugaaaguaaacaaauugagaucaauaucgacgguaagaaaaagcuaaaaacuguggggucuaagguauguccuaaauccagcccacuguuccagguuuuuaagauuuggcagauacucaacaauauccaggugauugagaagucgacaggaaaaucuaaguuccuggaacaagaugagaaagaaauccuuuuuaaggagcugaacuucaaagacaagauuuccaagaccgaugccuugaaaauccucuauaagaauuacaaagagcuggacuuuaacuucaaggaaaacauagagggcaaucguacucaggcuacauuuuuaaaagccuuccagucaaucauugaacugaguggccacgaggucagcgauuucuccaagaucaagaccgacgaaauucuagagaucgugacgcccauauuugagggguucggauuuaacaccaaucuccugcaguucaacucuaaucuuaaagguaaggauuuugaaaaacaagcaguguaucaguuguggcaucugcucuacagcuucgagggcgacaacucaaauacagggaacgaaaagcugauucagaaaaucagugagcuuuacggauuugaacgcgaguaugcuauuaucauagccaauaucuccuuccaaccugacuacggcagccugucuacuaaggcgauuagaaagaucuugccacaccucaaagaggguauugaauuuucacuggccugcgaguaugcaggguacaggcauaguaagaacagcuuaaccaaagaagagaagaauaaaaagauccugaaagauaagauagacauucuacccaagaacucccuccggaauccugucguugagaaaauccugaaccagaugaucaaugugguaaacgcuacaauugagacuuauggcaagccagaugagauccgaauugaacuugcccgcgaguugaaaaagucugcuaaagaaagagaggaccugaccaacgccauaaauaagucgacacucgaucacgagaaguacaaagcacuguuacagaaggaguucggacugagcaacguguccaggaaugacaucauucgguauaaacuuuacuuggaacucgaacacaacggcuuucauacccuguacucaaauacuuauaucgagccgaacaagcuauucaguaaagaauuugauauugagcacaucauaccccagucucgccuguucgacgauagcuucuccaauaagacgaucgagucaagaagcgccaacauugaaaaggggaaugagacagcuuuugacuacgucucuaacaaaaauggagaagugggucucaaggauuaucugaaaaacaucgaggaccuuuucaauaacggcaagauuuccaaaaccaaguacaauaaguugaaaaugaagggggaugaaaucccuagugacuuuauagcgagggaccugcgugauacucaauauauuagcaaaaaggcaaaaucuaucuuagaggaccucguuaaggauguggucuccaccggaggcucaaucacagaccggcugcgagaggauuggcagcuuauugacauaaugaaggaacugaacugggauaaauacgacaaguugggucucaccgaggugaucgaaaacaaugaugggcauaaaauuaacagaaucaaggacuggacuaaaaggaaugaucaccgccaccaugccauggacgcucugacaauugccuucacgaagcggaguuauauccaguaccuaaacaaucugaacgcaagaagcgauaaaucgggcuccauauacggaaucgagcagaaggaacucuauagggacaagaauaacaaacugcgcuuuaagccacccauuccucuugacgauuuccgagccgaggcuaaaaagcaauuggagaauacccugguaucuaucaaagccaagaacaagguugcaacuauuaauaucaacaauaccaaaaagcagggcggggaaaacaaaaagaaacaguuaacaccacggggacagcuccaccuggagacaauauacgguagcauucaacaguaugugacuaaggaagagaaggucggcgcgaauuuuaacaaagagcuuaucgaaaagguggcuaauaaaaagugucgugaggcccugcuaaaaagacucaucgaguucgacaacgaucccaagaaggcauuuaccaggaaaaacucacugaauaagaacccguuguacauugacacgaucaaaaccuauaaggucccugaaaaagugaagacaguuacuaccgaaacaauauacacuauucgcaaagauaucaaucccgaccugaagauugauaaggugguagacaaaaagaucaaaaacauauuagagcuccggcugaaggaguucaauggggaugccaaaaaggcuuuuaguaaccuugacgaaaagccaauuuggcugaauaaagagaagggaaucuccaucaaaagagucaccauuacgggcaucucuaacgccauugcauugcaugauaagaaagacaaggaagguaauuucauacucgacaaccaggggaagaaacaagcuguggauuucguuaauacaggcaacaaucaccauguggccaucuauaaggacgagaaaggaaaccugcaggaaaaugucauuaccuuuuacgaggcgguggagaggguaaaccagggcaucccuaucauugauaagacuuacaaacagaacgaaggguggcaauuccuauuuagcaugaagcagaaugaguauuucguguuucccaacgaaaagacaggauucaauuccaacgagauagaccugcuuaauccagaaaacuaccaccucaucucacccaaucuguuucgaguucagaaaauugccaccaaggauuauuucuuucgccaccauuuggagacuaacgucgagaauaucaccacaacgaaagaccugaccuggaagcgguuaggcauuaacgguaucauaaauauccucaaagugagaauuaaccacaucgggcagauugugagcgucggagaauacuga

SEQ ID NO: 3164 - RNA, 4122 nt, Artificial Sequence
  Cas9 variant
augaccaagaaaaacuacagcaucggccuggacauugggacaaauuccgugggaugggccgucauaacugaugacuauaagguucccgcuaaaaagaugaaagugcucgguaacacggauaagaaguacaucaaaaagaaucuucugggcgcauuguuauucgacucuggggagaccgccgaagcgacaagacugaaaaggacugcucggcgccgauauacccguagaaagaacaggcuacgguaccuccaggagauuuuugccgaagagaugacaaaaguagaugaaucauucuuucaacgccuggacgagaguuuccuuagaugggaugacgauaauaagaagcugggaagguauccuaucuuuggcaacaaagcagacguggucaaguaccaccaggaguucccaaccauuuaucauuugcggaaacaccucgccgauagcuccgaaaaggcugaccugcgccugguguaccucgcauuagcccauaugaucaaauuucgaggucacuuccugauagagggggaacuuaaugcugagaacacugauguucagaagaucuuugccgacuucgugggagucuacgacagaacauuugaugacucucauuugucggagauuaccguggaugcggcaucaauccugacggaaaagauuagcaagaguaggcggcuagagaaucucaucaaguauuacccgacugaaaagaagaacacccuguucggcaaucuuauagcccuggcuuugggccuccagcccaacuuuaaaaugaauuucaagcuguccgaggacgccaaauuacaauucucuaaggauagcuaugaagaggaccugggggagcuccuuggaaagauuggugaugacuacgcagaucuguuuacauccgcuaaaaacuuguaugacgccauccuacugucaggcauucucaucguagaugacaauaguacuaaggcgccucugagcgccucuaugaucaaacguuacguugaacaccaggaggaccuugaaaagcugaaagaguucauuaaggcaaacaaguccgaauuguaucacgauauauuuaaagacaagaacaaaaauggguacgcuggauacaucgagaacggcgugaagcaggaugaguucuauaaauaccucaagaauacccugucaaagauugccgguagcgacuacuuuuuagauaaaaucgaacgcgaggacuuccugagaaagcagaggacauuugauaacgggaguauaccacaucaaauucaccuacaggaaaugcaugcuauccuccggcgacagggagacuauuaucccuuccugaaagagaaucaggaucgcaucgaaaagauucuuaccuuuagaaucccuuacuaugucggcccauuggccaggaaagacucucgguucuccugggcagaguaccacagcgaugagaagauuacgcccuggaacuuugacaaagugauagauaaggaaaagucggccgagaaauucaucacucgcaugacacugaaugaccucuaccugccugaagagaaggugcuuccaaaacacucucaugucuaugagaccuacgcuguuuauaacgaacugacuaagauuaaauacgugaaugagcaaggcaaggacuccuuuuucgauucaaacaugaagcaggaaaucuucgaccacguauuuaaagagaauagaaaggugacaaaagaaaaguugcucaacuaucugaauaaagaguucccggaguacaggaucaaggauuuaauugggcuggacaaggaaaacaaaaguuuuaaugcgagccuaggaaccuaucaugaucucaagaaaauacuggacaaggcauuccuugaugacaaagucaacgaggaagugaucgaggauauuaucaagacguugacccuguuugaagacaaggauaugauucacgagcgucuccagaaauacuccgacaucuucacagccgaucaacugaagaaauuagagcggcgacauuacacugguuggggcagacugucuuauaaacuuauaaacgggaucaggaauaaagaaaacaauaagaccauuuuggacuaccucaucgacgauggaagcgcuaaccgcaauuuuaugcagcugauuaacgacgauacacuacccuucaaacagaucauacagaagucacaaguugugggcgacgucgaugacauugaggccgugguacacgaucugccugguaguccagcaaucaagaaagggauucuccaguccguuaagaucguggacgaacuggucaaagugaugggcgauaaucccgacaacauagucaucgagauggcccgggaaaaucagacuaccaacagaggaaggagccagucucaacagcgccuuaagaaauugcaaaauucacugaaggaguuaggcaguaacauucucaaugaggaaaagccuagcuauaucgaggauaaaguggaaaacucccaucugcagaaugaccagcuuuuucuguacuauauucagaacgggaaggacauguacacaggagaugaguuggacaucgaucaccucucugacuaugauauagaccacauuaucccacaggcuuucaucaaagaugacucgauugauaaccgaguucugaccagcuccgccaagaaucgggguaaaucagacgaugugcccagucuagacaucguacgugcaagaaaggcggagugggucaggcuguacaagucuggccucauuagcaaacgcaaguuugauaaccugacuaaagcugaaagagggggacuuacggaggccgacaaggcaggcuucauaaaacggcaguugguggaaacaaggcaaaucaccaagcauguugcccagauucuggacgcucgauuuaauacugaguccgaugaaaacgacaaggugauccgcgaugucaaagugauuaccuuaaagucaaaucucguaagccaguuccggaaagacuucgaguuuuacaaggugagagagaucaacgauuaucaccacgcccaugacgcauaccugaaugcuguugucgguacagcccuucugaaaaaguauccgaagcuagcgucugaguucguguacggggaauauaaaaaguacgauauaaggaaauuuaucaccaacuccagugacaaggccacugcuaaauauuucuuuuacagcaaucucaugaacuucuuuaagcgugugauucgcuacucuaauggcaaagucaucguucggccugugguggaauauuccaaggauacagaggacauugcaugggauaagaaaucaaacuucagaacgaucugcaagguacugaguuacccccaagucaauauagugaaaaagguugaaacccagacuggaggcuuuagcaaagagucgauuuugccaaagggggacuccgauaagcugaucccuaggaaaacaaagaaagccuauugggacaccaagaaauacggagguuucgacucucccacaguggcuuauagcgucuuugugguugccgauguggagaagggcaaggcaaagaaguuaaaaacuguaaaggaacucgucgggaucucaauuauggagcgaaguuucuucgaagagaacccaguggaauuucuggagaauaaaggauaccacaacauacgggaggacaaacuuaucaagcugcccaaauauuccuuguucgaauuugagggcgguaagcgcagacuccuggcgucugccagcgaacuacagaaagggaacgagauggugauuccuggccaucuggucaaacuucucuaccacgcucagaggaucaauuccuucaacucaaccaaauaccuggauuauguuagcgcccauaagaaagaguuugaaaagguguugaguuguguagaggacuucgcaaaucuguacguggaugucgaaaagaacuuaucuaaaauucgggcuguggccgacuccauggauaauuuuagcaucgaggaaauaucgaacucauucaucaaucuccugacgcuuaccgcacugggagccccagcugacuuuaacuucuugggcgagaagauuccgcgaaaaagauauacaucuacuaaggagugccucaaugcgacccugauccaccaaaguauuacagggcuauacgaaacucgcaucgaucuguccaaaauaggagaggaauga

SEQ ID NO: 3165 - RNA, 4122 nt, Artificial Sequence
  Cas9 variant
auggagaacaagaauuacagcaucggccuggacauugggaccaacuccgugggaugggccgucauaacagaugacuauaaaguucccucuaagaaaaugaaggugcucgguaauacugauaaaagauucaucaagaagaaccuuauuggcgcucuguuguuugacgaagggacgaccgcagaggccaggcgguuaaaacgcacagcgcgacguagauacacuaggcggaagaaucgccugagauaucuacaggaaaucuucgcugaggaaaugucaaaaguagauaguagcuuuuuccacaggcucgacgauuccuuucugauuccugaggacaagaaaggaucuaaguacccaaucuucgccacccuuauagaggaaaaggaguaucauaaacaauuuccgacaaucuaccaucugcggaagcaguuggcagauucgaaagaaaagaccgaccuccgccugauuuaucuggcccucgcucacaugaucaaauaccgaggccacuucuuauacgaggauacuuuugacauuaagaacaaugauauccagaaaauauucaacgaguuuauuucaaucuauaauaacacauucgaagguaauagccugagugggcagaacgugcaagucgaggcaauuuuuaccgacaagaucuccaagucugccaaaagagaaagggugcuuaaguuguuccccgacgagaaaagcacgggacuguucuccgaauuucuaaagcucaucguuggcaaucaggcugauuucaaaaagcauuuugaccuggaggagaaggccccucuucaguucucacgggauacuuacgacgaagaucuggagaacuugcucggccagauuggggacgauuuugcggaccuguucguggcagccaaaaaguuauaugaugcuauacugcucaguggaauccuuaccgucacagacccaagcacuaaagcuccccugucugcauccaugauugaacguuacgagaaucaccaaaaggauuuggcuacccuaaaacaguuuaucaagacaaaccugccugaaaaguaugacgagguguucucagaccagagcaaagaugguuacgccggcuauauagacgggaagaccacgcaggagaguuuuuacaaauacauuaagaaccuccugucuaaauucgaaggagcggauuauuuucuugagaagaucgaacgcgaggacuuccugagaaagcaaaggacuuuugauaauggcuccaucccacaccagauucauuugcaggaaaugaacgccauccuccggcgacaaggugagcacuaccccuuccugaaagagaauaaggaaaagauugagaagauauuaacauuccgcaucccuuauuacguagggccacuggcaagaggaaacagggacuuugcuuggcuaacccggaauagcgaucaggccauucgcccguggaacuucgaagagaucguugacaaagccucgucugccgaguccuuuaucaauaagaugacuaacuaugaucucuaccugcccgaagagaaagugcuuccuaagcauucauugcuguaugaaacauucgcagucuacaaugagcucaccaaggugaaauuuauugccgaaggccugagagacuaccaguuccuugauaguaggcagaagaaagacauauuuuauacgcuguucaaggcugaggauaaacguaaggugaccgagaaggacaucauucaauacuugcacacagucgacggcuaugaugggaucgaacucaaaggaauugagaagcaguuuaacgcgagccuguccacuuaccacgacuuacugaaaaucauaaaggauaaagaguucauggacgauccaaauaacgaggaaauccuagagaauauuguucauacccucacaaucuuugaggaccgggaaaugauuaagcagcgacuggcacaguaugauucucuuuucgacgagaaggugaucaaagccuugacuagaaggcacuacaccgguuggggcaagcugagcucaaaacucauaaacgggauucgcgauaagcaaacaggaaaaaccauccuggacuauuuaauggaugacggcuacaauaaccggaacuuuaugcagcugauuaaugaugacgaacuuaguuucaaggagaucauaaagaaagcucagguaguggguaagacugacgaugucaaacaggugguucaagaauugcccggguccccugccaucaagaaaggcauucuccagagcaucaagcugguggacgagcuagucaaagugaugggacaugagccagaaucuauuguaaucgagauggcaagagaaaaccagacgacagccaggggcaagaaaaauucacagcaacgcuacaaacgaauagaggauagucugaagauucucgcuagcgggcugaacgccaaaauccuuaaggagcaccccaccgacaauauccaguugcagaacgaucggcuguucuuauauuaccuccaaaauggacgugacauguauacugguaaaccgcuggauauuaaccagcuuuccucuuacgacaucgaucauauuguuccucaggcauuuauaaaggacgauucgcuggacaauagaguguugaccagccucaaggacaacaggggcaaauccgauaauguccccucacuggaaguggucgagaagaugaaaacauucuggcagcaacuacuggacaguaagcucaucucuuaucgcaaauuuaacaaucugaccaaggcggaaagagggggacuugaugagcgggacaaggugggcuucauuaaaaggcaguugguugaaacucgacagaucacaaagcacguggcucagauucuggaugcccgcuacaacacggagguaaaugagaaagacaagaaaaaccggaccgucaagaucauaacuuuaaagagcaaccucguguccaauuuuagaaaagaguucaggcuguauaagauccgugaaauuaacgauuaccaccaugcacacgacgccuaccuuaaugcuguuguggccaaagcaauccugaagaaauauccaaagcuagaaccugaguuugucuacggugauuaucaaaaguacgaccucaaacgcuauauuucacggagcaaggaucccaaagaaaucgagaaggcuacagagaaauacuucuuuuauucuaaccuguugaauuucuuuaaggaagaggugcauuacgccgacgggaccauaguaaaaagagaaaacauugaguacuccaaggauacaggcgaaaucgcguggaauaaggagaaagacuucgccacuaucaagaaagugcugaguuuaccacagguuaacauugucaagaaaagggaggugcagaccggaggcuucagcaaggaaucuauacuccccaagggaaauuccgacaaacugaucccucgaaagacgaaagauauucuuugggacaccacaaaguauggggguuuugauucaccagugaucgcuuacaguauucuguugaucgcagacauagagaaaggcaaggccaagcggcucaaaacugucaagacccugguugggaucacaauuauggaaaaagcuacuuucgaaaagagcccgaucgccuuucuagagaacaaaggauaucacaaugugcgcaaggaaaacauucugugccuucccaaguacucccucuucgagcugaaaaauggcagaaggcggauguuggcaucggcgaaggaacugcagaaagguaacgagaucguguuaccuguacaccucaccacgcugcuuuaucaugccaagaauauacaccgacuggaugaaccagagcauuuggaguacauucaaaaacacagaaacgaauuuaaggggcuccugaaccuagucucugaguucagccagaaauaugugcuggcugacgccaaucuugaaaagaucaagaaccucuacgcagauaaugagcaggcugacaucgaaauucuggccaacucauuuaucaauuuguuaacauucaccgcacugggcgcccccgcugcguuuaaauucuuuggaaaggauguugaccgcaaaagguacacuacagugagugagauacucaacgccacccugauucaucaauccaucacuggccuuuaugagacccguauugaucugucuaaguugggggaagacuga

SEQ ID NO: 3166 - RNA, 4125 nt, Artificial Sequence
  Cas9 variant
auggagaccaaguucacauacuaucugggccucgacauggggacugauagccuuggaugggccgugacggacuccucuuaccacauccugagagcuaaagguaaggauuuguggggcgucagguuauuucccucagcagaaaccaguguugagcggcgcacauaucgagugaaccguagaaggcggcagcgcgaaguagccagaauuggggcgcugaaagagcuauucgcugacgaaauagagaagguggauccuggauuuuucgucaggcucgacgagagcaaauuucauauggaagaucgguccgagaauaacaagcaaaaguacggccuguucgccgacaaacuguuuucugaugcagguuauuacaagaaauauccaacuaucuuccaccuucgcaaggaauugcucgagucggaggaaccgcaugacgugcgacugguuuaccuggcccucuuaaauauguuuaaacacagagggcauuuccugaacucaagccuucagauugagggagaaaauaguaacaucgcugaguccuaccagauguuuguggauaccuugacagacgaagaucuggacuuccccgagcaggucucuggcgagaggcuacaagaaauuuuucggagcuccgacucacguaagaagaaaguggagaaucuccuggcagaaaugaaccuuaguaagaaacagaagcgcgagauccaguucguaaaucugauaugcggcuugaaagggaagcucagcgaacuguucccugauaaagaguaugacgaggaacagaagaagaucgccuuuucuuuccaagauuccgacuacgaggauaaagaaaacaccauucaggaguuacuggacgaaucagagaugaauaugaucuaugcuguuaaggccgugcacgauagcggaguccucagugguauuaugaacggcgagagauaccuuucuguggcgaggguggcauccuaugaaaaacacaagaaagaccugcagaucuugaaggauauacuaaagaaauacgacacuaaggaguauuuugaaauguuccggaaugagagcgccaaaucggagucuuacuccgcuuacgucgggucaguuaaguaucauggaacauuucgacgcggccugaguggugggaaacaggaagaucucuacaagcacauuaagaaagugcugggaaaguucccacaagacgacgagggcguaaccuauauccuugaagagauugaaacggagagcuuucugcccaaacaguugacugccuccaacggcgugaucccuaaucagguccaugcaagagagaugcucgcuauccugaagcacgccgaauuauaccugccauuccuacaagagaaagaugacaccgggcucucugugagcgaaaagauucugaaacuuuuuauguuccagauacccuauuacguuggaccuuugggucaggaguauaaagauaagaaaggcuacaacgugugggcggaaaggaaggccucagggaaaaucuacccauggaacuuugaggacaagauugaugucaaaaagagugcagagaaguucaucggacggauggugcgcagauguacauaucuguccggcgaacaggcucucccgaaacaaagccugcuuuacgagaaguuucagguacugaaugaauugaacaaucucaggauacguggugagaaaauucccguuucucugaagcaggaaaucuaucacgacuuauucggggauggcaaaaaggugucaaugacucggcugaccaacuaccuacuccagaauggagucaucaguggcgaggagaaggacagcugcauuuccgggaucgauggagguuuccauaacucucugucgagcgugggcaaauuuaagggggucuucggagacacagugcacaccgaugaacaucgaaaaaugauugaggacauaaucuuuuggggcacgguuuucggugaugggaagaaacuuuugaaggaaaagguggaggagguauauggcaaucaacugacugaagcccagaaaaagagaauuuuuggauucaaauuuuccucauggggcaggcucaguaaggcuuuccugacaauggagggggccucuaaagacgacggagaaaucaaggguuuaauccaggcaaugugggauaccaacuguaaucugauggagcuuuugagcgaccgcuuuacuuacaaggauaaacucaacgaaauggucacaaccgccgagaagccucugugcgaguggaaaauugaagaccuagaugagauguaucuguccgcuccagugaagcggaugguuuggcagacgauaagaguggucgacgaagugcaacagaucauuggcugucccccuaaaaggaucuucguagagaugacccgcucagauggggaaaagggaaaacgaacagugagccggcagaagaagcucguugaccuguacaaagcgcuuggcaaggaggguaaaacuuggucugaggaauuguccgauaccccagagagucaguuucguauuaagaaacuguacuuauauuaccuccaaauggggaagugcauguauacaggcgaagcaaucgagcuggaacagcuuaugaaugacaaccuguacgauauagaccacaucuaucccagacauuucauuaaggaugacaauaucagcaacaauuugguccucgugaaaaaggagaaaaacgcccacaagucugacuccuuuccgauugagccugaaaucaggaacaaaaugaugcccuucuggaagucacugcgcaagaaaggauuccuaacugaggaaaaguacaaucggcugaccagaaugagugcuuuuacagaugaggagaaagccgcauucauaggcaggcagcucguggaaaccagccaagggacuaaggccauuacgcagaucuuugagcaggcuuucgccaacucggaaauugucuuuuccaaagcaucuguugugagcgcguuccgacagaaguuugacuguuauaaggugcgcugcguaaauaacuaccaccaugcucacgaugccuaccugaauaucgucgcaggaaacacauaucgggugaaauucaccucaaauccacuuaacuuuauaaaggaggccaaaaagaauccuaacaguagagaaaauagguacaacauggacaaaaucuucgagugggauguuacucguaauggcgagaccgcuuggguggcccaaacaaaggaacaucccgguaccauucaguuggucaagaaauaucugaacaaaaauuccccauuaaucacuaagaugguguacgagaagcacgggggaauuacacagaaagcaacgaucuggucugcuaagaaagccgaaagcggcaacaccgacgcguauauacccguuaagaugaacgauccucgccucgccgacgugacuaaguacgguggcguaacaaccauugcugucgcaggguauacacugcuugaguacaaagccggaggcaagacugugcggucccuggaagcucuaccaaucuaccucgggggaucaaagaagcugaccgaggagcagaugguggaauauuuuagcaaugucuugcaacaggagaacaaagaaaagguugugagugauguaaucauuagaaagaaaaugaucccgucuggcucccugauuaaguacaaugguuucuauuacuauuuagccgggaaaacgggagacaggauaauccucauuagcgcagugcagcugugucuucccauggauaccaugcuguacaucaagaaaauugagaaggcgugcucgacaggcaacuucgaagagaaggacaaaaaugguaagcaggucuugucaaaacaacagaacgaguuuguguaugaacucaucauacagaaguaccaacagucuaucuucaaaaagaagguuggcgccauuggggacacuaucauugagaaacgagaaaaguuugcugagaucagucuggaggaacaguguaaagugcuaaugcagauauuccugaauuuucaauccggaauuggcgucgagcuuaagaucaucgaagggggcaaaaagagcggagugaccuaccucaacaaaaagguuaugaaugugcaggagcugaaguugauugaucagucugucacagguguauucagccgggaaauagaccuguuaacuaucuga

SEQ ID NO: 3167 - RNA, 4125 nt, Artificial Sequence
  Cas9 variant
augaagaaaagauacagcuauuccaucggccuggacauugggaccaacucugugggaugggccgucauaaaugaggauuacaagguucccgcuaaaaagaugacaguguucgguaacacugacaggaaaacgaucaagaagaaucuccuuggcaccguacuguuugauucaggggaaacagcacaggcccggcgcuugaaacgaacuaaccguagaagguauacccggcgcagauacagguuaugccaacugcagaauauuuucgcgacagagauggugaaggucgacgauaccuuuuuccagcggcuaagugagagcuuuuucuauuaccaggacaaggcuuuugauaagcacccuaucuucggaaacuccaaagaagaacgcgccuaucauaagacuuacccaacaauuuaccaccuccgaaaggaccuggcagauagagaccaaaaagccgaucuuaggcugaucuauuuggcucucucucauauaaucaaguuucggggccacuuccugauugaggguaaacugaauagugagaacaccgacgugcagaagcucuuuaucgcauuaguuacgguguacaaucugcuuuucgaagaggaaccgauugccggggagacuugugaugcuaaagccuugcugaccgcgaagacaucaaaaagcaagcgucuagagagucucaucuccgaauuucccggacagaagaaaaacggccuguucggcaaucuucuggcauuggcccucgggcugcgcccuaacuucaagucuaauuuuggauuaagcgaggacgcuaaacugcagauaacuaaggacaccuaugaagaggaacucgauaaccuucuggccgagauuggugaccauuacgcagauuuguuccuagcugccaaaaaucuguccgacgcgauccuccugucagauauucuuacacugagugacgagaacaccagagccccauugagcgcaucuaugaucaagagguaugaggaacaccaagaagaucucgcucuguuaaagaaacuggucaaggagcagaugcccgaaaaauacugggagaucuuuuccaacgccaagaaaaauggcuaugcuggguacauugagggaaaggugucacaggaagacuucuaccgguauauaaagccuauccuaagccgacucaaaggcggugaugaguuucuggccaagauugaccgcgaugacuuccuuagaaaacagaggacguuugacaacgggaguaucccacaccaaauacauuugaaggaacugcacgcaauucuccggcgccaggagaaauacuaucccuuccuggccgaacagaaggagaagaucgagcaacuucugugcuuuagaaucccuuacuauguaggaccauuggcuaaaggcggcaauucuuccuucgcguggcucaagaggcguagcgaugaaccgauuacucccuggaacuuuaaagacguuguggaugaggaagcaucggcccaggcuuucaucgaggggaugacaaauuacgacaccuaucugccugaggaaaaggucuuaccaaaacauucuccccuguacgagauguuuacuguguacaacgaacuaacaaaggugaaauauauugccgagaauaugaccaagccucucuaccuguccgcagaacagaaggaggccauaaucgaucaccuuuucaaacagacgcggaaggucaccguuaaagacuugaaggagaaauauuucucacaaauugaaggacuggagaacguggauguaacagguguggaaggcgcuuuuaaugccagucucgggacuuacaacgaccuguuaaagaucaucaaggauaaagcauuccuggacgaugaggcgaaugcugaaauucuugaggagauagucuugauccucacccuguuucaggacgaaaagcuaauugagaaacgacuggccaaguaugcaaaccucuucgagaaaagcgugcugaagaaacuuagaaaaaggcacuaccgcggauggggccgguuguccagacagcugaucgaugguaugaaggacaaagccucugggaagacaauuuuagacuuucucaaagcugaugacuucgccaauaggaacuuuauccagcugauaaaugauagcucacuugacuucgaaaagcugaucgaugacgcacaaaagaaagcuauuaagcgcgaaaguuugacugaggccguugcgaaccucgccggcuccccagcuaucaaaaagggcauucugcagagccuaaaaguggucgaugagaucgugaagguaaugggacauaaccccgacaauauaguuauugaaaugucucgagagaaccagaccacagcacaggggcugaaaaaugcccggcaacgucucaagaagaucaaagaagugcacaagaaaaccggaucaaggauucuggaggauaacagugagagaaucacuaaucuuacguugcaggacaaccgccuguauuuauaccuccugcaggaugguaaggacauguacacaggccaggaucuugacauaaauaaccugagccaauaugacaucgaucauauuaucccgcaguccuuuauuaaagacaauucuaucgauaaccuaguccucaccacucagaaggcuaaucgggggaagucggacaacgugccuagcauagaagucgugagagauaugaaagacaggguuuggcgacgccaacuggccaauggagcaauuucccggcagaaguucgaucacuugaccaaagcggagagaggcggucuggccgacucagauaaggcuagguuuuuacgucgccagcucguggaaacacggcagaucaccaaacauguagcccaacugcuugacaguagauucaacucuaagagcaaucagaacaagaaacuggcaaggaacgucaagaucauuacuuugaaauccaagaucgugucagauuuucgaaaagacuucgggcucuacaagcugcgggagguuaauaacuaucaccacgcucaugacgccuaccuaaaugcaguggucggcacagcccugcuuaagaaauaucccaagcucgaagcugaguucguguacggagauuauaaacacuuugaccugguaaaguugauuagcaaaucugauccaucccugggcaaggcgacggccaagguguucuuuuacaguaacauaaugaauuucuuuaaagaggaauuaagccucgcagacgggacccugaugaagcgcccuguuaucgagacuaacacagaaaccggagaggucgugugggauaaagugaaggacuucaaaacaauuagaaagguccuuucuuacccccagguuaauaucgugaaaaagacugaaauucaguccggugcuuuuucaaaggagagugugcugagcaaaggcaacucggauaaguugaucgagaggaaaaaggggugggaccccaaaaaguauggaggcuucgauuccccaaauaccgccuacucuauauuuguagucgccaagguggcuaaacggaaggcacaaaaacucaagacgguuaaagaaaucguggguauuaccaucauggagcaggccgaauaugagaaggacaacauugcguuccuggaaaagaaaggguaccaggauauccaggagaagcuacugauaaaacuuccuaaguauagccucuuugagcuggaaaauggccgaagacgcuuguuagcuucagccaacgaguuccaaaaaggaaaugaacuggcacucaguggcaaguacaugaaguuccuguaucuugccuccagguacgacaaacugucuagcaagauugaguccgagcagcagaaaaaguuguuugucgaacaacaucuacacuacuucgaugagauccuggacaucgugguuaaacacgcuacauguuauauuaaggcagaaaacaaucucaaaaagauaaucucacuguacaagaaaaaggaggccuauagcauuaacgaacaggcgcuuaacauguuaaaucuguuuaucuucacuucgcucggggcuccaucuaccuuuguguucuuugacgagacaauugaucguaaacgguacacuaccuccagcgacguauugaacggaauccugauacagcagucgaucacgggccucuaugagacaagaauugaucugucaagguucgguggggacuga

SEQ ID NO: 3168 - RNA, 4125 nt, Artificial Sequence
  Cas9 variant
augaagaaacagaaguucagcgacuacuaucugggcuuugauaucgggaccaacuccgugggauggugcgucacagaccucgauuacaauguucuuagauucaacaaaaaggacaugugggguucuaggcuguuugaugaggccaaaacugcugcagaacggcgcgugcaacgaaauucacguagaagguugaagcggcgcaaguggagauuaaaccugcuagaggaaauuuucagugacgagauaaugaaaaucgauagcaacuuuuucaggcggcucaaggaauccucucuguggcuugaggacaaaaauucgaaggagaaauuuacgcuguucaaugaugacaacuauaaggauuacgacuuuuauaagcaguaccccaccauuuuccacuugcgcgaugaacucaucaaaaauccugagaagaaagacauucgacugaucuaucuggcccuccauucaauauuuaagagcagaggccacuucuuauuugaagggcagaaccugaaagagaucaagaauuucgagacacuuuacaacaauuugauuaguuuccuggaagacaacggaaucaauaaauccauugauaaggacaacaucgagaagcuagaaaagauaauuugugauucuggcaagggucucaaagacaaggagaaagaauuuaaggggaucuucaacagcgauaagcagcugguagcgauuuuuaaacuuuccgugggaucaagugucagccugaaugacuuguucgauacugacgaguacaagaaagaggaaguggagaaggaaaagaucucuuuuagggagcaaaucuaugaagaugacaagccaauuuacuauuccauacucggcgagaagaucgagcuguuagauauugcuaaaucauucuacgacuuuaugguucugaacaauauccucagcgacaguaacuauauaucugaagccaaggugaaacuuuacgaggaacauaagaaagaucugaagaauuugaaguauauuauccggaaauacaacaaggagaauuacgacaaacuauucaaggauaaaaacgaaaauaacuauccggcauacaucggccugaauaaggagaaagacaagaaggaggucguggaaaaaucccgucucaagauugaugaccugaucaaaguaauuaagggguaucuucccaaaccugagcgcauagaagagaaggauaagaccaucuuuaacgagauucugaauaaaaucgaauugaagacaauccucccaaaacagagaauuagcgacaacggaacccugcccuaccagauacacgagguugaauuagagaagauccuggaaaaucagucgaaauauuacgauuuccuaaacuaugaggagaacggugugucuacuaaggacaagcuccugaaaacauuuaaguucaggauuccuuacuacgucggcccacuuaauuccuaucauaaagauaaagggggaaacucauggaucgugcggaaagaagagggcaagauuuugcccuggaauuuugaacaaaagguggacaucgagaaaagugccgaagaguucauaaagcgaaugaccaacaaaugcacguaccugaauggugaggaugucaucccuaaggacagcuuccucuauuccgaauacauuauccugaacgagcuuaauaaaguucaggugaacgacgaauuucugaaugaggaaaacaagcgcaaaauuaucgaugaguuguucaaggagaauaagaaaguaucugaaaagaaauuuaaggaguaucuccuggugaaccagauagcuaauagaacugucgaauuaaaagggauuaaggacagcuucaacucaaauuacgugaguuauaucaaguuuaaagauauuuucggagagaagcugaaccuagacaucuacaaagagauauccgaaaagagcauccucuggaaaugucuguacggcgaugacaagaagauuuuugagaaaaagaucaaaaacgaauauggcgauauucuuaauaaggacgagaucaaaaagauaaacucuuucaaguuuaauaccugggggagguugucagaaaaacugcucacaggaauugaguucaucaaccuggagacuggugaaugcuacaguagcguuauggaggcauuacggcgcaccaauuauaaccugauggaacuuuuguccucuaaguuuacacuccaggagucgaucgauaaugaaaacaaagagaugaaugaggugagcuacagagaccugauugaagaguccuaugucucaccaagucuaaagagggccauccugcaaacccucaaaauuuacgaagagauaaagaagaucacgggccgugugccgaaaaagguauucauugaaauggcucgagggggagaugagucuaugaaaaacaagaaaauccccgcccggcaggagcagcugaagaaacuuuaugacagcuguggcaaugauauugcgaacuuuuccaucgacauaaaggaaaugaaaaauucauugagcucuuacgacaacaauucccugagacagaaaaaguuauaccucuauuaccugcaauucgguaaaugcauguauacugggagggagaucgaucuugaccgccuguugcagaacaacgauacauacgacauugaucacaucuauccucggaguaagguuauuaaagacgauagcuucgacaaucucgugcugguccuaaagaacgaaaaugcagagaagucuaacgaguacccagugaaaaaggaaauccaggagaaaaugaaguccuuuuggagauuccugaaagaaaagaauuuuauaucagaugagaaguauaaaaggcucaccggcaaggacgauuucgaacugcgcggauuuauggcccgacaacuugucaacgugcggcagacuacaaaagagguuggcaagauuuugcagcagaucgagcccgaaaucaaaauuguguacaguaaggcugagauagccagcucguuccgugaaauguuugacuucaucaagguaagagagcugaaugacacccaccaugcaaaagaugcuuacuuaaacauugucgccgggaauguguauaacacgaaguuuaccgaaaaaccuuacagguaucuccaagagaucaaggagaauuacgacguuaaaaagauuuauaacuacgauaucaaaaaugcgugggacaaggaaaacucccuggagauagugaagaaaaauauggaaaagaacacagucaauaucacucgcuucauuaaagaggaaaagggagagcuuuuuaaccugaacccaaucaaaaagggugagaccucuaaugaaauuaucagcauaaagcccaaacuauaugauggcaaggacaacaaacucaaugagaaguacggguacuauacaucacugaaagccgcauacuucauuuauguggaacacgagaagaagaacaaaaagguaaaaacuuucgagcggaucaccagaaucgauaguacauugauuaagaaugagaaaaaccugaucaaguacuuagugucccagaagaaacuccugaauccgaagauaauuaaaaagaucuauaaagaacagacccuuauuaucgacucuuacccuuauacuuuuacgggaguugauagcaacaagaaagucgaacugaagaauaagaaacaguuguaccucgagaagaaauacgaacaaauacugaagaacgcucuaaaauucguggaggacaaucagggcgagacagaagagaacuauaaguuuauuuaccugaagaaaaggaauaacaaugaaaagaacgagaccaucgaugccgugaaagaacgauauaacaucgaguucaaugagauguacgacaaguuucuugaaaaacucuccucaaaggauuauaagaacuacauuaauaacaaacuguauacuaauuucuugaacagcaaggagaaauuuaagaaacugaaguuaugggaaaagagucucauccugcgcgaguuccuuaaaauuuuuaauaagaacaccuacgguaaauacgaaauaaaggacucucagacaaaagagaagcuguucuccuuucccgaggacaccgggcggaucagauugggccagagcucgcucggaaauaacaaggaacugcuagaggaaucagucacuggccuguucguuaaaaagauuaaacuuuga

SEQ ID NO: 3169 - RNA, 4128 nt, Artificial Sequence
  Cas9 variant
augagcaacaagcccuacuccaucggccuggacauugggaccaauucugugggaugggccgucauaacagaugacuauaaaguuccuucaaagaaaaugaaggugcucgguaacacugauaaacacuucaucaagaagaaucuuauuggcgcucuguuguuugacgaggggacgaccgcagaagauagaagguuaaaacggacagcccgccgacguuacacuagaaggaagaaccggcugcgcuaucuacaggagaucuucuuugaagagaugaguaaacucgacagcggauucuuucauagacuggaugacuucuuucuuauuccagaagauaagaggggcuccaaauacccgaucuucgcgacccuggcugaggagaaggaauaucacaagcaauuucccacaauauaccauuugcggaaacagcucgccgacucuaaggagaaagcagaucugcgccugaucuaucucaccuuagcccacaugauuaaguaccgaggucauuuccuguacgaagagucguuugacaucaaaaauaacgauauucagaagaucuucaaugaguuuauaucaauuuaugacaacacuuucgaagggagcagucuuuccggacagaaugcucaaaucgaggcaauuuucacagacaaaaucucuaagagcgccaagagagaaaggguauugaaacuguuuccugaugagaaguccaccggccuauucucagaauuucucaaacugaucgugggcaaccaggcugacuucaagaaacacuuugagcuugaggaaaaggccccacugcaguuccccaaggauacguacgacgaggauuuggaaaauguccucgggcagauuggagacgauuuugcggaccuguucguggcagccaaaaaguuauaugaugcuauacugcucagugguauccuuacuguuaccgacccuagcacaaaagccccacugucugcauccaugauugagcgguacgaaaaccaccaaaaggauuuggcugcccuaaaacaguuuaucaagacuaaucugcccgagaaguauguggaggucuucucagaccagagcaaagacggcuacgcgggguauauagauggaaagaccacacaggaagccuuuuacaaauacauuaagaaccuccugaguaaauucgagggcaccgacuauuuucuugauaagaucgaacgugaggacuuccugcgcaagcaaagaacguucgauaaugguucuaucccucaucagauucacuugcaggaaaugaacgcaauccucaggcggcaaggggagcauuacccauuucugaaagagaacaaggagaaaauugaaaagauauuaacuuuccgaaucccguauuacgugggaccccuggcucgcggcaauagagacuuugccuggcuaacaaggaacuccgaucaggcuauucggccuuggaauuucgagaaaaucguagacaaggccagcucggcagaagauuuuaucaacaaaaugaccaauuaugaccucuaccugccagaggaaaagguucuucccaagcacucuuugcuguaugagacuuucgccguguacaacgaacucacaaaagucaaguuuauugcugagggccugcgcgauuaccaguuccuugacuccgggcagaaaaagcaaauagugaaucagcuguuuaaagaaaagagaaaggugaccaaaaaggauaucauucacuauuugcauacggucgacggauacgacgguaucgagcucaaaggcauugagaagcaguucaacgcgucacugaguaccuaucacgauuuacugaaaaucauaaaggacaagaaauuuauggaugacagcaagaaugaagcaauccuagagaacauuguucauacacucacuaucuucgaagauagggagaugauuaaacagcgucuggcccaauacgacucccuuuuugaugaaaaggugaucaaggcuuugacccggcgacacuauacaggguggggaaaacugucugccaagcucauaaauggcauuugcgacaaacagacugguaacaccauccuggauuacuuaauugacgauggggagaucaauagaaacuucaugcagcugauaaaugacgauggccuuagcuucaagaaaaucauucagaagucacaaguagugggagagacagacgacgucaaacaggugguuagggaauugccuggcaguccagcaaucaagaaagggauucuccaguccaucaagauaguggaugagcuggucaaggugauggaccaugcccccgaaagcauuguaaucgagauggcucgcgaaaaccagaccacugcccgggguaaaaagaacucucaacagagauauaaaaggaucgaggauucacuaaagaaucuggcaaguggacucgacagcaacauucugaaagagaauccgacggauaacauccagcuuaagaaugaccgcuuguuucuguacuacuuacaaaacggcaaggauauguauacaggggaagcgcucgacauuaaucagcuguccucuuacgauauagaccacaucauuccucaggcuuucaucaaagaugacucgcuugacaaccgaguucugaccagcuccaaggauaaucggggaaaaucagacaacgugcccaguuuggaggucgugcagaagcguaaagccuuuuggcaacagcuccuggauucuaagcuaauuagcgaaagaaaguucaauaaccugacuaaagcagagaggggcggucucaaugagcgcgacaaggucggguuuaucaaacggcagcugguggaaaccagacagauaacaaagcacguugcccaaauccuugaugcuagguauaacaccgaggugaaugaaaaagacaagaagaaccgaacuguaaaaauuaucacauugaaguccaaccuggucucaaauuuccgcaaagaguuucgguuauacaaggugagagaaauuaacgauuaucaucacgcccaugacgcauaccucaaugcuguuguggccaaagcgauccugaagaaguauccaaaacuugagccugaguucgucuacggcgaauaccagaaguaugaucugaaaagguacauaagccguucucgcaaccccaaggagguggaaaaagccacggagaaguacuuuuucuauuccaaucuacucaacuuuuucaaagaagagguacacuaugcugacggaaccauugugaagcgggagaauaucgaauacaguaaggauacuggcgagaucgcauggaacacagaaaaagacuucgccaccauuaagaaaauacugagcuauccacagguuaauaucgucaagaaaacagaggaacagacuguggggcaaaacggagguuuguuugauaauaacauugugucuaaggagaaggucguugacgcuuccaaacugauccccauuaagucaggcuuaaguccuaaaaaguacgggggauacgccagaccaaccaucgcauauagcgugcucgugacguacaaacagaauaacaagauaaagaauaccaugguaggcaucccgguccugacaaaacuugaguucgaaagggaccccaaccuguauuugcgaaaccucgguauuaauaacgugucgcacguuaucaagcuggugaaauacacuguccuagaguuuaagcauaaauaugggaccuaccggcgcuucauuguguccaaucaggaacugaagagagcgaaccaaaucuuuguuacaacuaagcagaugaaacuuauaucucaguauaccacgcucgauaagaaugagcacgacagccuguugaaaaacaaucagcaacugauucagucaaucuggaaccaguucuuagaguuuaugcucgccacagaucuggugaauaagaaacaguacgacgaacuuauccugaccaacaaucaaacuauugaggaauguaggaacaucaugaaucggguaauaacaaccuugaguuucacuaacauuaaugcuggccagaagaaaaucauuuuugaugacacccucucccugccuaucaagcgauggcaguucacagauucugacaagauggucaaaaagauaauugagagcacgcuaauccaucaguccaucaccggacuguacgaaacuagaauugaucuuucaaaacucggcgaggacuga

SEQ ID NO: 3170 - RNA, 4128 nt, Artificial Sequence
  Cas9 variant
augaaggaguaccacaucggccuggacauugggaccagcuccauaggaugggccgugacagauucucaguucaaacucaugagaaucaaggguaaaacugcuauuggcgucaggcuuuuugaagaggggaagacggcagccgaacggcgcaccuuccgaacaacucguagaaggcugaaacggcgcaaguggagauugcauuauuuagacgagaucuuugcgccccaccuucaagaaguugaugagaacuuccuaaggcggcucaagcagucaaauauucauccugaggacccagcuaaaaaccaggccuuuaucggaaagcugcuuuucccggaucuguugaaaaagaaugaacgcggcuaccccacccucauaaaaaugcgagacgagcugccuguggaacagagagcacacuauccaguaacaaacaucuacaagcugagggaggccaugauuaaugaggaucggcaauuugaccuccgugaaguguauuuagcuguccaucacaucgugaaguaccgcggucacuuccugaacaaugcaaguguugauaaauuuaagguggggagaauugacuucgauaaaaguuuuaacguccuuaaugaggccuaugaagaguugcagaacggagaaggcuccuucaccaucgagcccucuaagguggagaaaauaggccagcugcuacucgacacuaagaugaggaaacuggaucggcagaaggcuguagccaagcugcuggaaguuaaaguggcggacaaggaggaaacaaaacgaaauaagcaaauugcaaccgccaugucgaaauugguccucggguacaaggcugacuuugccacgguggcaauggugaacggaaaugaguggaagaucgaucugucaagcgaaacuagcgaggacgagauugaaaaauuccgcgaggaauuauccgaugcucagaacgacauccugaccgagaucacaucucucuucagccagauuaugcuuaaugaaauagucccuaacgguauguccaucucagagaguaugauggauagauacuggacucaugagaggcagcuggccgaaguuaaggaguauuuggcgacccaaccagccagcgcacggaaagaauuugaccagguguacaacaaguauauuggccaggcucccaaagagaagggguucgaucuagagaagggacugaaaaagauccucucuaaaaaggaaaauuggaaagagauagacgaacugcuuaaggccggcgauuuucugccuaagcaacgcauuuccgcuaacgguguaaucccacaccagaugcaucagcaggaguuggacagaaucauugaaaaacaagccaaguacuauccguggcucgcaacagagaaucccgccaccggggagagggaucgucaccaggcuaaauacgaacuggaccaguuagugucauuccggaucccuuauuacgucggaccacuggugacgcccgagguucagaaggcgacuagcggcgcaaaauuugccugggcuaagcgaaaagaagacggcgagauuacaccuuggaaccuaugggauaagauagacagagccgaaagugcagaggccuucaucaagaggaugaccgugaaagauacuuaccuccugaaugaggacguccuuccagcuaacucuuugcuguaucaaaaguacaaugugcucaacgaacugaauaacguacgcguuaaugggcggagacuuuccgugggaauuaaacaggauaucuauacagagcuguuuaagaaaaagaagaccgucaaagccagcgacguggcaucguuggucauggcgaagacgaggggugugaacaaacccucuguugaaggccucuccgauccgaagaaauucaauucaaaccuggcuaccuacuuagaccugaagaguaucgugggggauaagguagacgauaaucgcuaucagauggaccuagagaacauuauagaauggcgaagcgucuuugaggauggagagaucuucgccgacaaacucacagaaguggaguggcugacugacgaacagcgguccgcacuuguuaagaaacguuacaagggcugggguagauugucuaaaaagcugcucaccgggauuguggaugagaacggccaaaggaucauugaccugauguggaauacagaucagaacuuuaugcagaucgucaaucagccuguguucaaggagcaaauagaccaguuaaaccagaaagccaucacuaaugauggaaugacccugcgcgaacggguagagagcgugcuugacgaugcuuauacaucaccccaaaacaagaaagccauuuggcagguugucagagugguggaagacaucgucaaggcaguuggcaaugcuccaaaaaguauuuccaucgaguuugccaggaacgaagggaauaagggagagauaacccgaagccgccggacucaguugcagaaacucuucgaggaucaagcgcacgaacuggugaaggacacgucucuaacagaggaacuggagaaggugccugaucucucagacagauacuacuucuauuuuacccaggguggcaaagauauguacacuggggaccccauuaacuucgacgaaaucaguaccaaguaugauauugaccauauccugccacagagcuuuguaaaagaugacucccuugauaauagggucuugacaucucguaaggagaacaauaaaaagucggaccaggugcccgccaagcuguacgcugcaaaaaugaagccuuauuggaaccaauuacucaaacagggacugauaacccagcgcaaguucgagaaucuuacuauggauguugaccagacaaucaaauaccggagccugggcuuugugaagagacaauuggucgaaacgcgacaggugauuaagcucaccgccaacauccuggguuccauguaucaggaggcugggacugauauuaucgaaacaagggccggccuaaccaaacaacugcgggaggaguucgaccucccaaagguucgcgaggugaacgauuaccaccaugcaguagacgcguaccugacaacuuuugccggacaguaucuuaauagaagguacccgaaauugcggucauucuuugucuauggcgaguacaugaaguucaaacacgggagugaccugaaguuacgaaacuuuaauuucuuucaugaacucauggagggagauaagucucaggguaaagugguggaccagcaaaccggcgaacugauaacgaccagagaugaggucgcugacuauuucgauuggguucaggaccuuaagcugaugcuagugacaaaagagcucaagcgcagcaacgggaaacuguucgaugccacuauucagaaugcaaacuacaccaaguugaaugaaaggaagaaaguauuugugccccugaagaaagaguuagacaagacacucuauggauccuacucaggcauccagagcucuuacaugacuaucgucaaaaaguucgauaaaaaggguuccaccuaugcugugcaacguauuccuguuauguacaguaagcugcuugaacuggagaaagaacagagcaaguugaaccggcucgugcagucuaucgucacguccgacccacaggcccccaauaacuuugaggugcugaugccuugcguucuaucagggcaacuggugauugauaauggcagaaaauucacacuuaccaguuauagguaccaguguagcacugcacagcucuuucugccaaagaaagacuugaaguauauacagaacaauuucaaggagcugaaaaagacacccgauaaacaagacaagaucuuugaaaccauuuacgacgauaucuuaaaacaggucgacaaguauuucucgcucuacgauauuaacaaguuucgcuccaaacugcacgacggaaaggauaaauuccuugcccuggagaauuuuggcgaaaaggagucuaaagacaagguaaucacuaagauauugcgagggcuccacgcuaacgcggaaagaaccagccugaaagagaucggacuaucaacaccgcugggccaguuccaaaguggugaagggggaauuacgcuuuccgauaacaccaagaucauuuaccagucuccuacuggccucuucgaacggcauguguaucugaaagacuuguga

SEQ ID NO: 3171 - RNA, 4128 nt, Artificial Sequence
  Cas9 variant
augagaaagaaccaggagcccuacaauaucggccuggacauugggaccagcuccauaggauggucuaucaugaacgauaauuucgaccucaugagggugaaggguaagaaaggcauugggguccggcuuuauaacgaaggacaaucagccgcugagcgccgaaugcaccguacagcaagaaggcgguacggccgcagaaaguggaggcugcgguuguuagaagacuuuuucgaugagcauauggccgaaguugaugacacguuuuucgcgcgccugaaagauaguaauaucagcccuaaggacgauaagaaauaucgaaagucccuacucuuuccaaaaucuaagggugugacuuaccaggacgauggggaguucuauaaaaaguacccgaccauguaucaccugagauacgcucuuaugacagagcauaggaaguuugaccugcgggaaauuuacuuggccuuccaccauaugguaaaauaucguggaaacuuucucuacgauacuucgguggacucauucgaggcaaagaaucuggacaucaaaggcaaguuugaugaaauaaacgaccugcucagcaguuauaccgauuucuacgucgacaauuccaacgccgcuuuaguggagucuauccugcuugagaaaaauacaacccgcaaggauaaaagcaagaagauugcaaaauugcugcacguugaagacaaggagaaaggcaagaacaaaaaggccaaggaucuagcuacucagaucuccaaugccgugcucgggcugaaaugcaacuuucaccuuauuuucgaacugcagcaaaaguauucauucgacuuguguagugagaaaacagaagagaauaucgcgaagcucagcgagguccuggaugaaaaccagaaaauguuacugaugauacucaaggaggugcaggaccagguaaugcuuaacgcauuuguucccucuggaaugucccugucagaagccaugaugcaaaaguacgaugacuauggugagcaguugaaaauuuaccaugaacuagagcacagcgugagugacgauucugcugccaagcugagaggcgcauacagggacuauaaugauaacaucauuaaacggaucgacggggauaauaagaaagacaccuucuacaagcgagucaagaacauccucacgaaaauuuccaaggaguauguggaucaggacgugcuggaaagcugcggaaaacuuaagaaacugauagaugagaauaaguuguuuauccgccagagaacugcugccaacggcguccucccucaucaacugcaccagauugaaaugaggaaaaucauagacaaucagaaggaguacuauccaugguuagcggaacccaacccuaaugagaagcggcgcguuuacucgaaauauaagguggaggaacugauugccuucagaaucccauacuacguagguccccuaguggauccuaacaaugcagacaaaaacaaggaggcuagguuuucuuggaugguccguaaaaaggauggggaaaucaccccauggaauuucuaugacaagguggacugggccgaguccgcuaacaauuuuauugagcggaugaaaucaaaggauacauaccuccugggagaagacguugugccgaaagagaguaugcuuuaucaaaaguacgaagucuugaacgagcugaacaaucuccgaaucaacgauagcggccuguccgacucuuucgaagaugugaaacuuaagcaggccauuuauaaugaccuguuuaagaaacagaagauaguaaaaaucacugauuugcagaacuaccucguucaaaaucacaaguaucuggugaaacccaagauuagcggcuuagcagacgagaacagauuccugucaagucuauccaccuacagcgaucucaagacaaucuuuggggacaaagucgaugacaggaccuacuucaaugauuuugagaagaugguggaauauucuacggucuucgaggacggacaugacuacaaccagaaacuggaugaauauacuuggcuuacaaaggaggaaaaauacaagaucgguaaaaagcgcuaucggggcugggggaaguugucaaagaagcugcucaccggacugagagacaaaaauaaccacacuauuauggauaauuuaugggagacaaacaggaauuucaugcagauacagaccgccgacgaguuuaguaagcaaaucgcugaagagaacgaacgccaucugaaaggcagcguguccgaugcgauuaaugacauguacacgucuccugcaaacaagaaggccauccgacagguucuucgggugguagaugacauucagaaagcuauggguuaugccccaucgagcaucuccuuggaguucgcacgugaagaugggcccucagucagaaccgugaguagggccaaccgcaugaagucuauauacgagaaauacgcuagcgagguuuccgaagaggugaugaaggaccucgauggcgucaucaaagacaagaagggacugaaugaccggcuauaucuguacuuugaacagcaaggcaaagauauguauucagggcacccucucgacuucgauaaggugauuagcggacaggaguacgacaucgaucauauucugccacaggccguaaucaaagacgauucucuugacaacagaguguugacaacuaaggcacugaauaacgauguuaaauccaaggguguccccuguaggauguuuaauggcaugcacaguuucuggaagaacuuauaugacaaaggguuuauaagccgacgcaaguucaauaaccucaccacaaauccggagaacauugauaaauacaagaugaaaggauuugugaaucggcagcugguggaaacuagacaaaucauuaaacuugucgcgaacguucugaaugacaaguaucagaacgaugacguggacaucauagaggugagggcugaauugacccacgauguacguaaacauuucaaguuuuacaaaaaucgcaacgucaacgacuaccaccaugccuucgaugcauaucucacaucuuuuaucggccacuaccuguucaagaaauauccuaaucuacggccccuguucgacuacaacgauuuuaugaagguguccgacaauguuuucaaacagcucagagguaacaauuuucugggggaguuccuuaacaagaccggcgauauuaucucaacugacggaaauuuuguguugaacaaggaagagaugauuaauaaacugaacaaggccuaugcuuucaaaaagaucuuagucacgaaagaggugggccaaaggacaggggccauguuuaaugaaacccgauacccagcaccuaacagucggaaggcugcccucaaguaucgcagaaugcccaaaccagauagccugauaucgguuaaggacuacaaaaauacugauauuuacggagguuauuccggcaagaacgacgcguacauggugaucguagauauggggaaacaguauauggucgugggagugcccgucagguacaccgagaaacuugacaagcugcggaucaaacacucugaacuauaucgagacgagcucagaaagguucugagccgcgauaaaacauugcuggacucaaagggcaaugugaaaagguucgauauuguauuagaccgugugcucuacggucagcugaucgaagaugggaacgagcuuuuuacccugggcaguuccaaguauaagcggaauuucagacaguuguuucucgacaaacaaugcauugagauacuggauucuagcgccacuccucagccaacagacgaggaacuaaucugggucuacgaucagauucuggacaagguggauaaauacuucgaacuuuaugacaucaacaggcagcgcgagacgcuccgaaagggcagagcugcauucuguucccugccgaacauuucaaugaaaaaggacgauguuaccaaaaagaagaucuugaaugaaauacugguggccuuacaugcuaacgagagcgagaguaauugcgaaaagaucggaaagaaagucuuugggcggcuccaagugcccggaggcauuaagcugucuaaagaggccaaacuuaucuaccaguccccuacuggucuguucgaaaggguuguguauuugaaggaccucuga

SEQ ID NO: 3172 - RNA, 4128 nt, Artificial Sequence
  Cas9 variant
auggagaacaagaaauacagcaucggccuggacauugggaccuccucuauaggauucgccguggucgaugaaaauaacagaguuaugagggugaaggguaaaaaugcuaucggcguacggcucuuuucagaggggcagcccgcagccgaccgccgaaguuuccguacaacuagaaggcggcuuagccgcagaagguggcggcugcgcuuguuacgagaaauuuuugagccuuauaucaacccaguggaugaagcguucuuuaugagacugaaggaguccaaucuaucuccgaaagacgcuaacaagcacuacucgggagauauucucuucaauaaccaaacggaccaggauuuuuaugagaaguaccccaccaucuaucaucugaggcacgcccuuaugacagaacaucggaaauucgacguccgugagauauaccuggcaauccaccauauugugaaguuucgcggccacuucuugaaugccgcuucagcaagcaacuuuacuguugguaaacucaaucuggaagggaaguucgaugcccugaacgagaucuaucagagagugcucaccgacgauccuuuugcuuuaaggacagacaaucuggaucacauuaaagagauccuuauagacaacaagcggagucaggccgaccgacaacgcaccuugacuggagaugucuaccaguccucugaagagaaggaaauugagaaaagaaauaaggcgaucgcaacagaaauucugaaagccgcugugggcaacaaggccaaacuaaacguaaucaccaauguugagguggacaaggaggcagcuaaagauuggagccucacguucgacuccgaaacuaucgaugacgagcuggccaaggucgauggccagaugaccgacgaugggagggaaauuauagagauccuucggucacuguacaguggaauuacauuggcggccaucgugccagaaaaccauacucucagccagucuaugguggagaaguauaauucccacaaagcacaucugaaguuacugaaagaccucauaaacaauaugaccgauacaaagaaagcuaagaaccuucgcgccgcuuacgacgguuauauugacggcgucaaggggaaaguucugaccagagaugacuucuacaagcaaauccagggaaauuuggaugacucagccgaggcacagaaaauccaggaugugauggaccaagaugaauuuaugcccaagcagaggacgaaagccaacggcagcauuccucaccagcuacaacagcaggagcuggaccagaucguagaaaaucaaaaggaguauuacccauggcucgcugaagagaaccccaaugagacucgucgggguguggcgaaguauaaacuggaugaacuugucacauuccgagugccuuacuacguugggccaaugauuaccgcagaggaccaggaaaagcagaguggagccucuuuugcuuggaugaaaagaaaggagccgggcaacauaacucccuggaauuucgaucagaaaguggacaggauggccuccgcaaaccaauuuaucaagcgcaugacaaccacggauaccuaucuguugggcgaggacguccucccugcccagagccuguuauaccagcgguucgaagugcugaaugagcuaaacaagauuagaaucgacaggaaaccaaucucgauugaacucaagcagcaaauauuuaacgaucuguucaaaaaguuuaaaaauguaacaaucaagcaccuucaggaguauuugguugcuacugggggauacgacaaacgcccccgaauugauggucuggccgacgaaaagcgguucaacucuggccucuccgcauaucaugaucugcacgggauccuuggagcggagguggucgacgcuaaugauaagcaggacgaucuggagaaaauuaucgaauggucaaccauauuugaggacaagaaaaucuaccgugccaaguuggaugaacucacauggcugacugacagucagaaagagaaguuagcaaccaagagauaucaaggcugggguaggcugagcaaaaagcuacucuccgggcugcgcaacucugaucaucggagcauucuugacaucuuguggauuacaaaugaaaacuucaugcagauccaggccgacccugauuuugcugagcuggugaaaaaugccaaccaaggcaugcucggaaagaauaacucacaggacgucauaaaugaucuguacaccaguccacagaacaaaaaggcaauuagacagaucuuacuggugguucacgacauucaaaaugcuaugcauggccaggcccccgcgaagauccacguggaguucgccaggggagaagaacgaaacccgcgccgguccauacagagacagcaccaaaucgaagcugcauacgauaaaguaacuagcgaccuuuuggucgaugccggggugaggcaggagcucaaggacgcuauuaaugauaaacgugacuucaaggaucgccuguuucuauauuucaugcaggguggccgggacaucuacaacggggaaccuauuaacaucgacagacugucuucauaugauauagaccauauucucccccaggccuuuguuaaagaugacagucugaauaacagggugcuuacggaugcagagggaaaucgacgcaagagcgacgcggucccauccgaguuguucggcgccaagaugcggucuacaugggaacugaugagagagcaagguuuaaucucgaaagcuaaguacaggaaccucaccaugaauccugaaaacaucaaugcccacacugagaacggguuuauuaaucggcagcugguggagacccgacagguaaucaaacuugcagugaacauucuggcugaugaauauacagaggacacccaaauaguuagcgucaaggccgauuugucccaucagaugagagaagacuucgagcuccugaaaaaucgcgaugugaacgacuaccaccacgcauuugaugccuaucuagcugcguucaucggcaauuaccugcucgaaagguaccccaagcugcagucauauuuuguguacggagacuucaaaaaguuuagucagaaggacacuaaaaugcgucgguucaacuuuauuuaugaucuuaagcauucugaccaaaucgccgauaaaaauggcaagaaaauuuggcacaagacaaacgacuuggauuacaucagacaucuguucgcauauaagaaaauauuaaucagccacgaggucuccgagaggcgcggggcucucuacaaccagacgguuuauaaggccucagacgauaaagccagcggacaggguucuaagaaacugauuccaaucaaggcuaauaagcccaccgaaauuuacggcggguacacuggaaaaacacuugcauauauggccaucgugaaggugauaaaaggcaagaaaauugcguacaagguagucggugugccuaccuccgcucugguucagcuagccgggaucgagcauggcagucaagaggagcucaaccgacuguaugacguguugaagccacaguucacacagcugaaaaagaauaacaaaacuggagaaaucagcgagaccgucucuaaguuugagauugugauaccgagaguuaaauaccagcaauuaguggaagaugacgauaaacucuucaugaucggcuccgacacguaucccuacaaugcacagcagcugguacuuucagagggggcccugaaggucauuaacaauguguaucggaagggagaaaacagugauaagcaggagagcuacaaauuggacgacguguacgaugaaaucauuaucgcuaugaagaaauauuuuccucucuacgacaauaggggcuuccgcgagaaggucgcagaggguaaaucgaccuuugaaaaccugccaauauccaaugaguucaagaacgggaagcuaacaaaaaucggaaagaaagaaguuauuaaucguaugcugcaaggccuucacgccaacgcgacuaugaccgaucucaagauccuggguauuaaaucucccuuuggcuucaugcagcagccuacagggaucgcuuugagcgagaaugcccaacugauauaucagucaccaacugacuuauuugagagacgggugcagcucaacaagauuaaguga

SEQ ID NO: 3173 - RNA, 4128 nt, Artificial Sequence
  Cas9 variant
augaagaaaauccugggccucgaccuugggaccacaagcauuggaugggcccugguguacgaguccgaaaacacugaugagaagucuucaauagucagauuggguguuagggugaaucccuuaaguguagacgaaaaaggcaacuucgagaaggggaaagcuaucacgaccaaugcagaucggcagcaaacacacggagcccgcauuaaccugcagcgauauaagcuacguagagaaaaucucaaggacugccugcagaaacagggcuggaucgguacugaggcgcuuugugaggaagggaagaccagcacauuugagaccuacaugcugagggcuaaagccgcagaagaggagauuuccuugcaugaacucugccgggugcuguucaugaugaacaagaaacgcggauauaagucuaauagaaaggccaacaauaaagaggauggcaagcuguuugacggcaugacugucgcuaaaaagcucuacgaggaacacuuaacuccugcagaauauucguuccaacugcuuucaagcgggaaaaaguuuaaacaggaguacuauaggagugauuugaaggaggaauuugaccggaucuggaacgagcagcagaaguacuacccagaaauacugaccgaugacuuuaaacaacagcuacagggaaaguccaaagguaauacgucuaagaucuuccucggcaaauaugggauuuacagcgccgaucugaagggacuugaccgcaagcugcagccguugaaauggcgaguggaggcucucaagcaacagguugauaaagaagugcuggccuuugucaucuccgacuuaaacggccagauugcgucaacaaguggucugcucggggcaaucagcgacagaucuaaggagcuuuauuucaauaaacaaaccgugggacaguaccuguggacauccuugaaggagacuccccauguaucaauaaagaacaaaccuuuuuauaggcaggauuaccuagacgaguucgaaaagauuugggaaacccaggccacauaucacaaagagcugaccccagaacucaagcaagagauccgggauauuaucaucuuuuaccagcguccccugaaaagcaagaagggccuuauuaguguuugugagcuggaacagcgcaaagugaaggucacgauagacggcaaagagaaggaaaucucuauugggccuaaaguggcuccaaaguccagccccauguuccaggaguucagaaucuggcaaaauuugaacaacauacuccugauugauaaaggaaauaacucgauccauccuuuauacgaggaagagaagaaucugcuauaugaggaacucucugugaaggaaaaacuguccaaggccgaggcacuuaaagucuugaacaaaaauucaaaacagugggaccugaacuacaaggagaucgaagguaauaggacucaggcuguucucuaugauugcuacaaccggauuaucgugaugacaggccacgaggaauauaauuuuaagaaacugaaggccagugagauucgaagcuacguaaaaaccacuuucacagggcuuggauuuaacaccgacauacuggaguucgauuccucuuugacgggccacgaacucgagaagcagccaauguaucaacuguggcauuuacuguacagcuacgaaucagacaauagucgcaccgguaacgaugcgcuacucagaaaacuggagacagccuuuggguucccgaaggaauaugcagcugugcuuuccgacgucguguuugaggacagcuacggcaauuugucuguuaaggccaugaggaaaauccugccccaccuccaggcuggacugaacuauucacaggccugugaagaggcaggcuacaagcauagucggcgcagcuuaacuaaaaaugagcuggaucagaaggaauauaaagagaaacuugaauugcucccuaagaacucccugcacaacccaguggucgagaaaauucuaaaucaaaugaucaacgugaucaaugccguaauugacgaguacgggaagcccgaugaaauaagaaucgagcuggcuagggaacucaaaauuggagcggcagagcgugaaaacaugacccggucuaucaaucaggguaacgccgagaauaagcgaauuagagagauccuggaaaaagaguucgcucuuucguauauaagcaggaacgacaucauuaaguacaaauuguacgaggaacugaaguccaauggcuuuaagacauuauauucagauacuuacaucaguaaagacaaacucuucucuaaggauuuugacauugaacacaucauaccuaaggcccgccuguucgaugacagccuuuccaacaaaaccauugaggcacgggauguuaauaucgccaagucaaacaagacagcuuuugacuucauuagcgagaaauaugaucagcaagggaucgaagccuacaagaaaaagcuggacauauugcuccaggacggaucuaucuccaaagcaaaguauaauagacugcuaaugaaggaggcggauauuccaaguggcuucaucgacagggaucugcgcgacacccaguacauugcuaaaaaggccuaugaaauccucagcgaucuggugcgaaacgucacucccacgacaggugcagugaccucucggcuucgugaggacuggcaguuggucgaugugaugaaagaacugaauuuugagaaguaccaaaaauuagggcucguugaggugauagaagacagagauggcaggaagauuaagcgcaucaaagacuggacuaagcggaacgaucauagacaccaugccauggacgcucugaccaucgccuucacaaaaccguccuacauucaguaucuuaacaaucugaacgcaaggucagauaagaauaguagcaucuacggaauugagaacaaagaacuacaccgagaggacaauaagcuccgcuuuaacgcuccucugcccauaaaugaguuccgggccgaagcgagaaggcauuugaagucgauccugguauccgucaaagccaagaacaaagugaugacccagaauguuaacgugauuaagacuaaacacggcgucaucaagaaagugcaguuaacaccacguggggagcuccacaaugcuacguuuuauggaaccaagaagcgcccuauuaucaaaaugguaaaggugggugcagcccuggacgaaguuacuauaaagaaggucucuagcucauucauccgggaggcacuucuggauagauugcaugaauacaacggcgacgccaaaaaggcauuuacagggaggaauaguauugauaagaaccccaucuauauugacgaggagcacaaaaagaccgugccagcgcucgugaaaacaaucgaaugggagauguaccaucccacucgaaagcugauauccccugaucuaaaaauugacaaggucaucgauaagggaauccgggaaauucugaaaacccgccuugccaaguucaauggcgacgcucaaaaagccuuuucuaaccucgaugagaacccaauauauaaggacgaagcuaaaaagaucacgcugaagagaguuagcuuggaggguguguccucagugauuccgcugcacaccuuaaaagauagggaggggaagcucguagucggcaaagacggaaagcccgugcugggcgacuacguucagacaagcaauaaccaccauaucgcuuucuacauggaugaaaaugggaaccuucaggacaauguggucaguuucuucgaggccgcagaacggaaaucucagggagugccuguuauugauaagaacuauaaucacgacaaaggcuggaacuuucuguucacuaugaagcaaaaugaguacuucguguuuccaaacgaaguaaccgguuucaaucccuccgaggucgauuugauggacgaggccaacuauagcaucauaucgccuaaucucuaccgagugcagaagaugucaaaggcuucugggagagauuauugguuucgccaucaccuggaagcgaugcuaaacgacgauccaaagcugaggaauaguauguucaaacguaucacaucccuuaaggcccucgagggaauugugaaaguccggaucaacugcauuggcaagaucguugcagugggugaauacgacuga

SEQ ID NO: 3174 - RNA, 4128 nt, Artificial Sequence
  Cas9 variant
augagcaacaaguccuacucuaucggccuggacauugggaccaauucagugggaugggccgucauaacagaugacuauaaaguucccaguaagaaaaugaaggugcucgguaacacugauaaacacuucaucaagaagaaucuuauuggcgcucuguuguuugacgaggggacgaccgcagaagauagaagguuaaaacggacagcccgccgacguuacacuagaaggaagaaccggcugcgcuaucuacaggagaucuucagccaagaaauuuccaaaguagacucuucguuuuuccauagacucgaugacuuuuuccuggugccugaggauaagaggggaucaaaauacccaaucuuugcgacccuugucgaagagaaggaguaucacaagaaauucccgacaauauaccaucugcggaagcacuuggcugacagcaaagaaaagaccgaucuccgccugaucuaucuggcccucgcacauaugauuaaauaccgaggccacuuuuuauacgaggaaaguuucgacaucaagaauaacgauauucagaaaaucuuuuccgaguucauaucuauuuaugacaauacuuuugaggguaagagccuguccgggcagaacgcccagguggaagcuaucuucacagacaagauuucaaaaaguaccaagagagagaggguucuuaaauuguuccccgaugaaaagagcacgggacuguuuucugaguuccuaaaacucaucgugggcaaucaagcagacuuuaagaagcacuucgaucuggaagagaaagccccucuucaguuuuccaaggacacuuacgaugaggaccuggaaaacuugcucggccagaucggggaugacuucgcugaucuguuuuuagucgccaaaaagcuguaugacgcgauucuccuuucaggaauacugaccgugaaagauuugagcacaaaggcaccacuaagugccucuaugaucgagcgguacgaaaaucaucagaaggaccuggcugcccucaaacaauucauucagaacaaucugcaggagaaguaugacgaaguauuuuccgaucagagcaaagacgguuacgcaggcuauaucgaugggaagacuacccaagaggcuuucuacaaauacauaaagaaccuucugucgaaguuugagggagccgacuauuucuuggauaaaauugaacgugaggacuuucucaagaaacagcgcacauucgauaauggcucuaucccccaccagauccaucugcaagaaaugaacgcgauuaucagaaggcagggugagcacuacccuuucuuacaggaaaacaaggagaaaauugagaagauacugaccuuucggaucccauauuacguugggccccuagcccgaggaaauggcgacuucgcauggcucacgcgcaacuccgaucaggcuauuagaccuuggaauuuugaagagaucguggaccaagccucaagugcugaagauuucaucaacaaaaugacuaauuaugaccuguaccuuccagaggagaaggucuugccgaagcacagccugcucuaugaaacauuugccguguacaacgagcugaccaaagugaaguucauugcagaaggccuuacuagguaccaguuucuggauaaaaagcagaaaaaggacauauucgacacauuuuucaaggccgagaauaaacggaaggucaccgaaaaagauaucauucauuauuugcacaacguugacggguacgauggaaucgagcucaaggguauugagaaacaguuuaaugcuucccugucuacguaucaugacuuacugaagaucauaaaggauaaagcguucauggacgauagcaagaacgaagagauccuagaaaauauuauccacacccucacaauuuuugaggaccgcgaaaugaucaaacaaagacuggcacaguacgauucacuuuucgacgagaaggugauaaaagccuugacuaggcgucauuauaccggcugggggaagcugagugcuaagcucauuaacggaauccgggauaaaaaguccggcaaaacaauucuggacuacuuaaucgaugacggugagauaaaucgaaacuucaugcagcugauccacgacgaugggcuuagcuuuaaggaaauuauccagaaagcccaaguauucggcaagacuaaugacgugaaacaggucgugcaggaguugcccggaucuccugcaauuaagaagggcauccuccagucaauaaaaauuguugaugaacuggugaaggucauggggcacgccccagagaguaucgugaucgaaauggcuagagagaaccaaaccacagccaggggaaagaagaacagccagcagcgcuauaaacggauugaggacucccuaaagaaucuggcaucuggucucgauucgaacauccugaaggaaaaucccaccgacaacauucaacuucagaaugauagauuguuucuguacuacuuacagaacggcagggacauguauacugggaaaccucucgagauaaaucagcugagcaacuacgauaucgaccauauuaucccacaagcguucauuaaggaugacucccuugacaaucgcguacugacgucaaguaaagauaaccgaggaaagucugacaauguucccagcuuggaaguggucgagaaaaugaaggcuuuuuggcagcagcuccuggauuccaagcuaaucucagagcggaaauucaacaaucugacaaaggccgaacgugagagaggcggucucaacgaacuggacaaagugggguuuauaaagaggcagcuugucgagacccgccaaaucacuaaacacguggcacaguucuuggaugcccgguuuaauaaggaaguuaccgagaaggacaaaaagaacagaaacgugaaaauuaucacacugaaaagcaauuuaguaucuaacuucaggaaagaguuuggccucuauaagguccgagaaauuaaugauuaccaucacgcucacgacgccuaucugaacgcagugcuugcuaaggccauccugaaaaaguacccgaaacuagagccugaguucguuuauggagauuaccagaaguacgaccuccagcgcuauauauccaaaagucgggaacccaaggaaguggagaaagcgacccaaaaguacuucuuuuauagcaaucuguugaacuucuuuaaggaggaaguccauuacgccgauggcacuauugugaaaagagagaauaucgaauauucuaaggacacaggggagaucgcuuggaacaaagaaaaggauuucgcaacggugaaaaagguacuguccuuaccacagguuaauauugucaagaaaaccgaggugcagacuggagguuuuucaaaggagaguauacucccuaaaggcaacagcgacaagcugauccccaggaaaacaaaggaaauucuuugggacaccacaaaguacgggggauucgauucgccagugaucgccuauuccauucuguugaucgcugacauagagaaaggcaaggccaaaaagcucaaaacugucaagacccugguugguaucacgauuauggaaaaggcaaccuuugagaaaaaucccaucacauuccuagagaacaagggguaccacaaugugcguaaagaaaacauucugugccuuccuaaguacucucucuuugagcuggaaagcggccgccggagaauguuggcgucagccaaagagcugcaaaagggaaaugaaaucguguuaccaguauaucucacuacccugcuuuaccauaguaaaaacguccacaagcuggaugagccggagcauuuggaauauauacagaagcacagguacgaguucaaagaccuccugaaccuaguguccgaauuuucucagaaguauguucuggcugaugccaaucuugagaaaauuaagaaccucuacgcagacaaugaacaggcugauaucgagauccuggccaacagcuucauuaauuuguuaacauuuacugcacugggcgcccccgcugcguucaaauuccucgggaaggacguggaucgaaagcgguauaccacggucuccgagauccugaacgccacacuuauacaccaaucaauuaccggacuguacgaaacucgcaucgacuugagcaaacuaggcgaggauuga

SEQ ID NO: 3175 - RNA, 4128 nt, Artificial Sequence
  Cas9 variant
auggagaagaaauacagcaucggccuggacauugggaccaacuccgugggaugggccgucauaacagaugacuauaagguucccucuaaaaaguucaaagugcucgguaauacuaacagaaagucaaucaagaaaaaucuuaugggcgcucuguuguuugauaguggggaaacggcagaggccaccagguuaaagcggacagcgcgccgacguuacacuagaaggaaaaaccggauucgcuaucugcaggaaaucuucgcuaaugagauggccaagcuagacgauagcuuuuuccaaagacucgaagaguccuuucugguagaggaagacaaaaagaacgagaggcacccuauuuucggaaaucuugcagaugaaguggccuaccaucggaacuauccaaccaucuaccaucugcgcaagaaauuggcugacucuccggagaaggcagaucuccgacugauauaucuggcccucgcucacaucauuaaauuuagaggccacuucuuaaucgaggguaagcugaaugccgaaaacucggacgucgcgaaacuguuuuaccaguugauucagacauacaaucagcuguucgaggaaucaccccuagaugagaucgaaguggacgcaaaggggauacucagcgccaggcugaguaaauccaagcggcuugagaagcugauugcuguuuuuccuaacgagaaaaagaauggauuguucggcaacaucauugcccucgcacugggcuuaaccccaaauuuuaaaucuaacuucgaucugacugaagacgcuaagcuccaacuuagcaaagacacauaugaugacgaucuggacgaguugcuagggcagaucggagaucaguacgccgaccuguucuccgcggccaagaaccucucagaugcaauccugcuuagugacauucugcguagcaauucugaagugaccaaggcucccuuguccgccucaauggucaaacgcuaugaugagcaucaccaggaccucgcucuguuaaagacgcuggugagacaacaguuuccugaaaaauacgccgagauauucaaggaugacacuaaaaacgguuaugcaggcuacguagggaucggaauuaagcacaggaagcggaccacaaaacuagccacucaggaggaauuuuauaaguucaucaaaccaauacucgagaagauggacggcgcugaggaacugcuugcgaaauugaaucgagaugaccugcuccgcaagcagagaaccuuugauaacgguagcauuccccaucaaauccaccugaaggaacuucaugcaauccugaggcggcaggaggaguucuacccuuucuugaaagaaaaucgcgagaagauugagaaaauccucacauucaggauuccauacuauguugggccgcuggccagaggaaacagucguuuugcuugguuaacccggaagucugaagaggccauaacgcccuggaauuucgaagagguggucgacaaaggcgcauccgcccagagcuuuaucgaacgaaugacuaacuucgaugagcaacugccuaauaagaaagugcuaccaaagcacucgcuccuguacgaauauuuuacaguguacaacgagcuuaccaaggucaaauauguuacugagagaaugaggaagcccgaauuuuugucuggcgagcagaaaaaggcuauuguggaccuucucuucaaaacaaaucgcaagguaaccgugaagcagcugaaagaagauuacuuuaagaaaaucgagugcuucgacuccgucgaaaucauugggguggaggaucgguuuaacgccucauuaggaacguaucacgaccugcuuaagauaaucaaagauaaggacuucuuggauaaugaggaaaacgaggacauucucgaagacaucguucugacccuaacacuguuugaggauagagaaaugauugaggagaggcucaagacuuacgcacaucuguucgacgauaaagugaugaagcagcuuaaacgccgacacuacaccgguuggggccgguugagucguaagaugaucaaugggauaagagacaaacaaagcggaaagacaauccuggacuuuuuaaaguccgauggcuucucuaacaggaacuuuaugcagcucauucaugaugacagccugacuuucaaagaagagaucgaaaaggcgcaggucucaggucagggggauagucuucacgagcaaauugcugaccuggccggcuccccugcaaucaaaaagggaauauugcagaccgugaaaauuguagaugagcucguuaaggugaugggccauaaaccagaaaauaucgucauugagauggcccgcgaaaaccagacaaccacuaaggggcugcagcaaagccgggagagaaagaaaaggaucgaagagggaauaaaggagcuagaaucucagauccugaaagagaaucccguggaaaacacgcagcuccagaaugagaagcuguaucuuuacuauuugcaaaacggucgagacauguacgucgaucaggaacuggacauuaaucgcuuaucagacuaugauguggaccacaucguuccgcagaguuuuauuaaagaugacagcaucgauaacaaggugcucacacgguccguagagaauagaggcaagucugacaacgucccuucggaggaagugguuaaaaagaugaaaaauuacuggaggcaacugcuuaacgcuaagcugauaacccagcguaaauucgauaaucuaacuaaggccgagcgcgggggacucagcgaagcagacaaggcuggcuuuauuaaacggcagcugguggagaccagacagaucacaaagcacgucgccaggaucuuggauucccgaaugaacaccaaacgggacaagaaugauaaacccauucgcgaagugaagguaaucacucugaagucaaaauuagugagugacuucagaaaggacuuccaacucuauaaaguuagggauauuaacaacuaccaucacgcgcaugacgccuaccugaaugcugucguggguacagcacuuauaaagaaauauccaaagcuggagucugaguuuguguacggggauuauaaggucuacgacguucggaaaaugaucgccaagagcgaacaggagauuggcaaagcuacggccaagcgauucuuuuauuccaacaucaugaauuucuuuaaaaccgaagugaaguuggcaaacggagagauuagaaaacgcccucucaucgagacuaauggcgaaacaggggaggugguauggaacaaggaaaaggauuucgcgaccgucaggaaagugcuggccaugccccagguuaauauagugaagaaaacagagguccagacuggagguuuuucaaaggaaagcauccuaucuaaacgugaguccgcuaagcugauuccacggaagaaaggcugggacaccagaaaguacgggggauucggcagucccacgguggccuauagcauccuuguuguggcaaaaguagagaaggguaaagcuaagaagcucaaaucugucaaggugcugguggggauuaccaucauggaaaaaggcuccuacgagaaggauccuauaggauuuuuggaagccaaaggcuacaaggacauuaagaaagagcugaucuucaaguuaccaaaauauucacucuuugaacuggagaacgggaggcgccgaaugcuugcaagugccacagagcugcaaaaggcuaaugaauugguccucccgcagcaccugguuagacuacuguacuauacucagaacaucagcgcgaccacaggaucgaauaaccuuggcuacauugagcagcaccgggaagaguucaaagaaauauucgagaagaucauugauuuuuccgagaaauauauccucaagaauaaggugaacucuaaucugaaaagcucauucgacgaacaauuugccguaagugauuccauuuuguuaucuaacagcuucgugucccugcucaaguacacuucauuuggugcaagcgggggauucaccuuucuggaccuugaugucaaacagggcaggcugcgcuaucagacggugacagagguuuuggacgcuacccuaaucuaccaaaguauaacuggucuguacgaaacacguaccgaccucucucagcugggcggggauuga

SEQ ID NO: 3176 - RNA, 4128 nt, Artificial Sequence
  Cas9 variant
augaagaaaauccugggccucgaccuugggaccacaagcauuggaugggcccuggugaacgaguccgaaaauaaggaugagcagucuucaauagucagauuggguguuagggugauccccuuaacuguagacgaaaaaggcaacuucgagaaggggaaagcuauuacgaccaaugcagaucggcaacaggugcacgccgcgcgcaucaaccugcagcgauacaagcuacguagagaaaaucucagggacugccugcagaagcaaggauggauuggcagugagccuaugugugaggaugguaaaagcuccacauuugaaacuuauaaacuucgggcuaaagccgcagucgaggaagugucucugcaugaguucgcccgcguuuuguuuaugcucaacaagaaaagaggguacaagucgaauaggaaggcuaacgacaaagaggaaggaaagcuguucgauggcaugaccaucgccaaaaagcuguaugaggaacaccucacaccagccgaguacucauuacagcugcuuaauaccggccggaaauuuacuccggaauauuaccgcagcgacuugauagaggaguucgaaaagaucuggaacgagcagcagaaauauuaccccgaaauucugacagaugaguuuaagcaacagcuagaagggaaggcuaaaaguaauaccuccaaacucuuccugggaaaauacgguaucuauucugccgacacgaagggccuugaucgaagacugcagccuuugaaauggaggguggaggcgaugaagcagcaagucgacaaggaugugcucgcauuuguaauuagcgaccugaaagggcagaucgccaacacuuccggauuacugggcgcuauaucagaccggaguaaggagcucuacuucagcaaacagaccauuggucaauaucuuugggccucucugcaggaaaauccacauaucuccauuaagaaccagcccuuuuaccgucaggauuauuuggacgaguucgaaaagaucugggagacacaagcaacuuaccacaaggaacuaaccucagagcugaagcaggagauccgcgauauuauaaucuuuuaucagagaccucucaaaagcaagaaaaaucugauugcuguuugcgaacuugagcagaggaaggugaaagucacaguggacgggaaggaaaaggagaucaccauaggaccaaaaauugcccccaagaguucuccuauguuccaagaguuccggaucuggcagaaccugaacaauaucuugcuccuggaucaugaaacgaacuccaaacgaccauuauacgaggaggaacgcaaucugcuauacgaggaacucagcgugaaggagaaacugucgaagacugaagcgcuuaaagucuugggcaagaagucuaaacagugggaccugaacuauaaggagcucgaaggcaauagaacacaggccguucuguacgauuguuauaacaggauuaucgugauguccgggcacgaggaaugcaauuuuaaaaagcugaaagcaucagacauucggcacuacguaaagaugauauucaagaaccuggcuuuuaauaccgauaucuuguguuucgacaguagccucaaaggacaugagcuggagcgccaaccgaugugccaguuauggcaccuucuauauuccuacgaaggugauaacucuagaacuggcaaugacgcccuccugaggaaacuugagacaaguuuuggguuccccaaggaauaugcugccguguuggcagacgucauuuuugaggauucauacggaaaccugagugugaaggccaugcguaauauccucccucaucugcaggcuggcaaagacuacucccaggcgugugaagaggcagguuauaagcacagccggcgaucuuuaaccaaggaggaacugaaccaaaaaguuuacaaggagaaacuugaauugcucccaaagaacucacugcacaaucccguggucgagaaaauccuaaaccagauggugaauguaauuaacgccguuauagaggaauaugggaagccugaugagaucagaauugaacuggcuagggaccucaagaucggcgccgcagagcgcgaaaauaugacgcggaguauuaaccagggaaaugccgagaacaaaagaaucagggagauacuggaaaaggaguucgcucuuagcuacuugucccgcaaugauaucauuaaauauaagcuguacgaagaguuaaaaucuaacggcuuuaagacccucuauucggacacauacaucagcaaagauaagcuguucuccaaggacuuugauauugaacauaucauaccaaaagcccgacuuuucgacgauucacugaguaauaagacuauugaggcacgggacgugaacaucgcgaaaucuaauaagaccgcuuuugauuucauuuuggagcguuacggggaacaaggagucaaaacauauaagacuaagcuccugagacuacuggaggacggugccaucagcaacaaaaaguacaauaaccuccugaaaaccgaagcagacauacccuccggcuucaucgauagggaccuucgcaauacacaguauauugccaagaaggcuuacgagaucuugucagaacuggugaagauugucaccccgacuacggggagcgugacaaaccgguuaagagaggauuggcagcucguugacgugaugaaggagcugaacuuugaaaaauaucagaaacuuggacuggccgauguaaucgaggacagggauggccgaaaggucaagcgcauaaaagacuggaccaagcggaaugaucacagacaucacgcaauggacgcucuaacuauugccuucaccaagccuucuuacauccaauaucucaacaaucugaacgcgagguccgauaaaaguagcucuaucuacgguauugaagugaaggaguugcaucgugaggaagggaaauuucgcuucaaugcaccccugccaaucaacgaguuucgggcugaagcaaagagacacuuaaaauccguucucgugucaauuaaggccaagaaaaaggucaugacacagaaugugaacaaaauaaagaccaaacacggcaucauuaagaaaguacagcugacuccuaggggagagcuucauaaugcuacauacuauggcacgaagaagcgaccccuggugcggaugguuaaagucggggccgcauuggacgaagcgaccaucaagcgcgugugcaguccagccauuagagcugcccuccugaaaaggcuaaacgcauacaauggagaugcuaaggaggccuucacuggucggaacagcaucgacaaaaaucccauauaucuggacaucgagcagacaaaacuugugccuguccucguuaagaccauugaauggggcauguaccacccaauccgaaagagaauuacaccggaucugaagaucgacaaagugauagauaaggggauucgcgagaaauugaaggcaaggcuggccgaauuuaacggagacgcucaaaaggcguucucgaauuuagaugagaaccccaucuauauggacgaagccaaacguaucacucucaagcggguguccauugagggcguacugucugcaauaccucuucauacccugaaagauaaggcugguaaaccagucaucgggagcgacggcaagcccguguuuggagauuacguucagacgucaaacaaucaccacauugccuucuauaucgacgauaagggcaacuugcaggacaauccugugagcuuuuucgaggccgcugaaagaaaaucccagggggucccagugauugacaggcgcuacaacugugauaagggauggcauuuuguuuucaccaugaaacaaaaugaguacuucguguuucccaacgaagcaacaggcuucaucccgucugagguagaccuccuggaugaagccaauuauugcauaaucagcccuaaccuauaccgaguccagaagcuguccaaagcgucagguagagacuauugguuucggcaccaucuugagacuaugcucaaugaugaccugagguugaagaacagcaccuucaaacgcauucagaguuuaaaggggcuggaggauaucgugaaggugcguauuaauucuaucggaaaaauagucgcuguuggcaaguacgacuga

SEQ ID NO: 3177 - RNA, 4128 nt, Artificial Sequence
  Cas9 variant
auggagaccaaguucacauacuaucugggccucgacauggggacugauagccuuggaugggccgugacggacuccucuuaccacauccugagagcuaaagguaaggauuuguggggcgucagguuauuucccgcagccgaaaccucaguugaccggcgcacauaucgagugaaccguagaaggcggcagcgcgagguagcgagaauuggggcucugaaagaacuauucgccgaugagauagaaaagguggacccuggauuuuucgucaggcucgaugagaguaaauuucauauggaggaccggagcgaaaauaacaagcaaaaguacggccuguucgcagauaaacuauuuuccgacgccgaguauuacaagaaauauccaacuaucuuccaucugcgcaaggaauugcucgagucugaggaaccgcacgaugugcgacugguuuaccuggcucucuuaaauauguuuaaacacagaggucauuuccugaacucgucacuucagauugagggggaaaauagcaacaucgcagagaguuaccagauguuuguggacaccuugaaggaugaagaacuggacuuccccgagcaggucuccggagaaaggcuacaagagauuuuucggucuagcgacucccguaagaaaaagguggaaaaucuccuggccgagaugaaccuuaguaaaaagcagaaacgcgaaauccaguucguaaaucugauaugcggcuugaagggcaaacucucagagcuguucccugauaaggaguaugacgaagaacagaagaaaaucgcuuuuagcuuccaagauucugacuacgaagauaaggagaacacaauucaggaauuacuggacgaguccgagaugaauaugaucuaugccguuaaagcggugcacgauucagggguccucagcggaauuaugaacggugaaagauaccuuaguguggcaaggguggccucuuaugagaagcacaaaaaggaccugcagaucuugaaggauauacuuaaaaaguacgacaccaaagaauauuuugagauguuccggaaugaguccgaaaagagcgagaacuacucggcuuacgucggcucuguuaaauaucaugggacuuuucgacgcggacuguccggcgguaagcaggaagaucucuacaagcacauuaaaaaggugcuggggaaauucccacaagacgacgagggaguaacauaugugcuugaagagaucgagaccgaaucauuucugcccaagcaguugacggccaguaauggcgucauuccuaaccaggugcaugcaagagagaugcucgcuauccugaaacacgccgaauuauaccugccauuccuacaagagaaggaugacacuggccucagcguuuccgaaaagauccugaaacuuuuuauguuccagauucccuauuacguggggccuuugggacaggaguauaaggauaaaaaggguuacaacgucugggcggagaggaaagaaccaggcaagauauacccguggaauuuugaggagaaaaucgacgugaagaagucugccgagaaauucauugggcggaugguacgcagauguaccuaucugagcggagaacaggcacuccccaagcaaucacugcuuuacgagaaauuucagguucugaacgaguugaauaaccucaggauccguggcgaaaagauaccugugagucugaaacaggagauuuaucacgauuuauucggugacgggaagaaggucuccaugacacggcugacuaauuaccuacuccagaacggcgugaucagcucugaagagaaagauucaugcaucaguggaauugacggcggguuccauaauagccuguccucugucggaaaguuuaaagguguguucggcgauaccguucacacagacgagcaucgaaagaugaucgaagauauuauauuuugggggaccguguucggagacggcaaaaaguugcuuaaggagaaaguagaagaggucuaugguaaccaacugacggaagcucagaagaaaagaaucuuuggguucaaguuuucgggcuggggaaggcucagcaaagccuuccugacuauggagggcgcuuccaaggauaauggggagauuaagggauuaauccaggccaugugggacacaaacuguaaucugauggaacuuuugucagagcgcuuuaccuacaaagacaagcucaacgaaauggugacuacagcagagaaaccacugugcgaauggaagaucgaggaucuagacgagauguaucugagugcccccguuaaacggaugguguggcagaccauuagagucguggaugaaguacaacagauaauggguuguccuccaaagaggaucuucguggagaugacgcgcucugacggcgaaaaagggaagcgaaccguuagccggcagaagaaacucgucgaucuguacaaggcucuuggaaaagagggcaagauuugguccgaagaguugaauaacacacccgagggucaguuucguaucaaaaagcuguacuuauauuaccuccaaauggggaagugcauguauacuggcgaaucaauugagcuggaaccgcuuaugaaugacaaccaccuguacgauaucgaccauauauauccuagacacuucaucaaagaugacaacauuagcaauaacuuggugcucgugaagaaagagaggaaugcgcacaagucugauuccuuucccaucgagccagaaauucgcaacaaaaugaugccuuucuggaagagucugcggaagaaaggauuccuaaccgaggaaaaguacaauagacugacaaggaugagcgcauuuacugacgaggaaaaagccgcuuucaucucucgacagcucgucgagaccucccagggcacaaaggccauaacccaaauuuuuaaacaggcauucgccgauucagagaucguuuuuaguaaggcuagcguggugucggccuuccgccagaaguuugacuguuauaaaguacggugcgucaacgacuaccaucacgcacaugaugcguaccugaauauuguggcugggaacacuuauagaguuaaguucacguccaauccccuuaacuuuaucaaagaagccaagaaaaauccaaacucuagggagaaucguuacaacauggacaagacauucgaaugggaugugacccgcaauggagagacugcaugggucgcccagagcaacgaaaaccccggcaccauacaauuggugaagaaauaucugaauaagaacucaccuuuaaucacaaaaaugguuuacgagaagcacggugggauuacccagaaagcuacuaucuggagugccaagaaagcagaguccggaaauacagacgcuuauauuccagugaagaugaacgauccgcggcucgccgacguaacgaaguacggcggugucaccacuaucgcgguggccggcuauacacugcuugaauacaaagcugggggaaagaccgugagaucucuggaggcacuacccauauaccucggcgggagcaaaaaucugacagaggagcagauggucgaauauuuuuccaacauuuugcagcaagagaauaaggagaaaguugugucagauguaaucaucaggaagaagaugauuccuagcggaagucugaucaaauacaacggcuucuauuacuauuuagccgguaagacugggaaucgaauugugcucauaucugcuguccagcugugucuuccaauggacaccaugcuguacaucaaaaagauugaaaaagccugcuccacgggaaacuucgaggaaaaggauaagaauggcaaacagguguugagcaagcagcaaaacgaguuuguuuaugagcucaucauugaaaaauaccagcagucgaucuucaagaaaaaggugggugcaauaggcgacaccaucauugagaagcgggaaaaauuugcggagaucucacuggaggaacaauguaagguccuaaugcagauuuuccugaauuuucagucugggaucggaguggaucuuacaaguguugacggcuccaacaaaagcggggugacuuaccucaauaagaaaauaaugaacgcccaggagcugaaguugauugaccaaucugucaccggaguauucagccgcgaaaucgaucuguuaacaaucuga

SEQ ID NO: 3178 - RNA, 4128 nt, Artificial Sequence
  Cas9 variant
augagcaacaaguccuacucuaucggccuggacauugggaccaauucagugggaugggccgucauaacagaugacuauaaaguucccaguaagaaaaugaaggugcucgguaacacugauaaacacuucaucaagaagaaucuuauuggcgcucuguuguuugacgaggggacgaccgcagaagauagaagguuaaaacggacagcccgccgacguuacacuagaaggaagaaccggcugcgcuaucuacaggagaucuucagcgaagagauguccaaaguagacucuucguuuuuccauagacucgaugacucauuucuggugccugaagauaagaggggaagcaaauacccaauuuucgcgacccuugcugaggagaaggaauaucacaagaaauuuccgacaaucuaccaucugcggaagcacuuggccgacaguaaagagaagaccgaucuccgccugauauaucuggcacucgcccauaugaucaaauaccgaggccacuucuuauacgaagaguccuuugacauuaagaauaacgauauccaaaagauuuucucugaguuuaucagcauauaugacaauacuuucgaagaguccucacugauuggucagaacgcucaggucgaagcaaucuuuacagacaagauuaguaagagcgccaaaagagagagggugcuuaaguuguuccccgaucagaaaucuaccgggcuguucuccgaauuucuaaagcucauccugggaaaucaagcugacuucaaaaagcacuuugaucuugaggagaaggccccucugcaguucucaaaagacacguacgaugaagacuuggagaaccuccugggccagauccgggaugacuuugcggauuuauuccugguugcaaagaaacucuaugacgccauucuucugagcggcauauugacugugaaggaucuaaguaccaaagcuccacugucugccuccaugaucgaacauuacgagaaucaccagaaggaccucgcagcucugaagcaauuuauucagaacaaucuucaggaaaaauaugacgaggucuucagcgaucagucgaaggacggguacgccggauauaucaacgguaaaacaacucaagaggcguuuuacaaguacauaaagaaucuguugucuaaguucgaaggcgccgauuauuuucucgacaagauugagcgugaagauuuccugcgcaaacagagaaccuuugacaacggguccaucccccaucagauccacuuacaagagaugaacgcaauucugcacaggcagggagaacauuacccuuuccuaaaggagaauaaagagaagaucgagaaaauucucauauuccggaucccauauuacgugggcccccuggcucgagguaaccgcgauuuugccuggcuuacaagaaauucagacgaagcuauuaggccuuggaacuucgaagagaucguagauaaggccaguagcgcagaggacuuuaucaauaaaaugaccaacuaugauuuguaccugccagaagagaagguucucccgaagcacucccugcuuuaugaaacguucgccguguacaaugagcugacuaaagucaaguuuauugcugaaggguugacacgguaccaguuccucgacaaaaagcagaaaaaggauauauuuuauaccuucuuuaaggcggaggacaaacgcaaggugacugagaaagacaucauucauuaccugcacacaguggauggauaugacggcaucgaauuagagggcauugaaaagcaauucaacgcaucucugagcaccuaccaugaucuacucaaaaucauaaaggacaaggaguuuauggaugacgauaaaaaugaagccauccuggagaacauuguccacacgcuuaccaucuucgaggacagagaaaugauuaagcagagguuggcucaguauaauucacuguuugaugagaaaguuaucaaggcccucacacgucggcacuacacuggguggggaaaacugagugcaaaguuaauaaacgguauucgagacaagaaauccggcaagaccauccuggauuaucuuauugacgauggggaaaucaauagaaacuucaugcaguugauacaugacgacggacucagcuucaaagagaucauucaaaaggcccagguguuuggcaaaacaaaugauguaaaacaggugguccacgaacugcccgguucuccugcuaucaaaaaggggauucuacagucaaucaagauaguggacgagcugguuaaagugaugggccaugccccagagaguauugucaucgaaauggcaagggagaaccaaacuaccgcgcgcggaaagaaaaacagccagcagcgguacaagagaaucgaagauucccucaaaaaucuggcuucuggccuugacucgaacauuuugaaggagaaucccacagauaacgugcagcugcaaaaugacagguuauuccucuacuaucugcagaacgggcgcgauauguacaccggaaagccucuugagaucaaucagcugagcaacuaugacauugaucacauaaucccacaagccuuuauuaaagacgauuccuuggacaaucgaguacucacuucaaguaaggacaaccgggguaaaucugauaauguucccagccuggaaguggucgagaagaugaaagcauucuggcagcagcuacuggacuccaagcucaucucagaacguaaguuuaacaaucugacgaaagccgagagagaaaggggcgggcuuaacgaguuggauaaggugggauucauuaaacgccagcuggucgagacacggcaaaucaccaagcacguggcucagauauuagacacuagauuuaauaaagaaguuaccgagaaggauaagaaaaacaggaacgugaagaucauuacacucaaaagcaaucugguaucuaacuuccgaaaggaauuuggccuuuacaaaguccgcgagaucaaugacuaucaucacgcccaugaugcauaccugaacgcugugguugccaaggcgauucuaaagaaauauccgaagcucgaaccugaguucguguacggugaguaccagaaauaugaccugaagcgguacaucuccagaaguaaagaucccaaggacauagaaaaagccaccgagaaguacuuuuucuauagcaauuugcugaacuucuuuaaggaagagguccaguaugcugaugggacuauugcaaaaagggaaaauaucgaguacucuaaggacacaggcgagaucgccuggaacaaagaaaaggauuucgcuacggugaaaaagguauuaucccucccacaagugaauauuguuaagaaacgugagguccagaccggaggcuuuucaaaggaaaguauacugccuaaagggaacagcgacaaacuuaucccccgcaaaacuaaggacauucugugggagacaaccaaguauggagguuucgauucgccagugaucgccuacuccauuuugcucaucgcagacauagagaaaggcaagucuaaagaacugaagacagugaaaacucuagucgggaucaccauuauggagaaggcgacguuugaagagaaucccaucaccuuccuggaaaacaagggauaccacaauguucggaaagagaacauucuuugccucccuaaguauagccuguuugaguuggaaaauggcagaaggcgacuguuagccucagcuaaagagcuccagaaggguaacgaaaucgugcugccaguguaccuuacaacucuguuguaucauaguaaaaaccuccacaagcuggaugagccggggcaccuagaauacauacagaaacaucggaaugaguucaaggaccugcuuaaccucguauccgaguuuucucaaaaguauauucuggccgaugcaaauuuggagaaaauccagaacuuauacgcugacaaugaacaggccgauaucgaaauucuggcaaacagcuucaucaaucuccugaccuuuacaacucuuggcgcccccgcugcguucaaguuuuucggaaaagacauagaucgcaagagauauaccacggucuccgagauucugaacgccacauugauccaccaaucaauuaccggccuauacgaaacuaggaucgaccugagcaaacucggggaggauuga

SEQ ID NO: 3179 - RNA, 4128 nt, Artificial Sequence
  Cas9 variant
auggaaaagagcuacuccaucggccuggacauugggaccaacucugugggaugggccgucauaacagaugacuauaaaguucccgcuaagaaaaugaaggugcucgguaauacugauaaaaaguacaucaagaaaaaccuucugggcgcauuguuauucgacucaggggaaacggccgagguaaccagacugaagaggacagcgcggcgccgauauacucguaggaaaaauagacuacgguaccuccaggaaauuuuugcuaaggagaugaccaaaguggaugaaaguuucuuucaacgccuggaggagagcuuccuuacagacgaugacaagaccuuugauucccacccuaucuucggaaacaaggccgaagaggacgcauaucaucagaaauuuccaacuauuuaccaccugagaaaguauuuggccgauucucaggaaaaagcugaccucaggcuggucuaccuggcacucgcccauaugaucaaguaccggggccacuucuuaauagagggugagcugaaugcugaaaacacagaugugcagaaacuuuuuaauguuuucguggagaccuaugacaagaucgucgacgaaucgcauuugucagagauugaaguggaugccagcaguauccugacggagaaaguauccaagucucgccgacuagagaaccucauuaagcaauacccgacugagaaaaagaauacccuguuugggaaccuuaucgcgcuggcauugggacuccagcccaauuucaaaacaaacuuuaagcugagcgaggacgccaaauuacaguucuccaaggauacuuaugaagaggaccuggaggagcuccuuggcaagguuggcgaugacuacgcugaucuguucauaucagccaaaaauuuguaugacgcaauucuacugagugggauccucaccguggaugacaacagcacaaaggcuccucugucugccuccaugauuaaaagauacgucgagcaccacgaagaucuugagaagcugaaagaauuuaucaagaucaauaaguugaaacucuaucaugacauuuucaaggacaaaaccaagaacggauacgcggguuacauagauaacggcgugaaacaggacgaguuuuauaaguaccugaagacgaucuuaacuaaaauugaugacucagauuauuuccuggacaagaucgaaagggaugacuuucuacggaaacaacguacauucgauaaugggagcauaccacaccagauucaucuccaggagaugcacaguauccugcgcagacagggagacuacuaucccuuucuuaaggagaaccaagccaaaaucgaaaagauuuugaccuucaggaucccuuacuaugugggcccacuggcacggaaagauucucgauuugcuugggccaauuaccacuccgacgagcccauuacuccuuggaacuucgaugaagucguugacaaggaaaagagcgcugagaaauuuauaacacgcaugacccucaaugaccuguaccuuccagaagagaaggugcugccgaaacauucgcacguauaugaaacguucaccguguacaacgaguugacaaagaucaaauaugucaaugaacagggugaguccuuuuucuucgaugccaacaugaagcaggagauuuuugaccauguguucaaggaaaauagaaaaguuacuaaggcaaaacuccugucuuacuuaaacaaugaguuugaagaguucaggaucaacgaucugaucgggcuagacaaggauucaaaaaguuuuaaugccagccucggaaccuaucacgaccugaagaagauucuugauaaauccuucuuggacgauaagacaaacggccaaauaaucgaagacauugugcugacucucacccuguuugaggaucgggacaugauccaugagcgcuuacagaaauacucugauuucuuuacaagccagcagcugaagaaacuugaaagaaggcacuauaccggcugggggcguuugucauacaagcucauuaauggaauccggaacaaggagaacaauaaaacuauacuggacuuccuaaucgacgauggucacgcuaaccgaaauuuuaugcaacugauuaacgacgaaagucucuccuucaagacgaucauucaggaggcgcaggucgugggcgauguagacgauaucgaagcaguugugcaugaccugcccgggagcccugccauuaaaaaggggauacuucagucugucaaaaucguggaugaguuggucaaggugaugggcgacaauccagauaacauuguuaucgagauggcuagagaaaaucaaacaaccgguuacgggaggaacaaaucaaaucagcgccugaagcgguuacaggacagucucaaggaguuuggcagcgauauacuguccaaaaagaaacccucuuauguggacucgaagguagaaaacagccaccuucagaaugacagacuguucuuguacuauauccaaaacggaaaagauauguacacuggcgaggagcucgacauugauaggcuguccgacuaugauaucgaccauauuaucccucaggccuucauaaaggauaauucaauugacaacaagguccuaaccaguucugccaaaaaucgcggaaagagcgaugacgugccauccaucgaaaucguucgaaaccggcguucauacugguauaaacuguacaagagcggacucauuucuaaaagaaaguuugauaaccugacaaaggcagagagggguggccuuaccgaagcugacaaagccggguucaucaagcgccaguugguggagacucggcagauuacaaaacacgucgcacaaauacuggaugcgagauuuaauacgaagagggacgaaaacgacaaagugauccgagauguaaaggugauuaccuuaaaguccaaucucguuagucaguuccgcaaagaguuuaaguucuacaaaguccgggagaucaacgacuaucaccaugcucacgaugccuaccugaaugcaguggugggaacugcccuucugaagaaauaucccaagcuaacaccggaauuugucuacggcgaguauaagaaauacgacguuagaaagcucauugcuaaaagcucugaugacuauuccgaaauggguaaggccaccgcaaaauacuucuuuuacucaaaccugaugaauuucuuuaagacagaggugaaauaugcugaugggaggguguucgaacguccugacaucgagacuaacgccgauggcgagguagucuggaauaagcagaaggacuucgauauagugcgcaaaguuuugaguuacccccaagugaacaucgucaagaaaguggaagcgcagaccggaggcuuuagcaaggagucgauucuguccaaaggggacucugauaaguuaaucccacggaagacgaaaaagguuuauuggaauaccaaaaaguacggagguuucgacagcccuacaguggccuauucaguacucgucguggcugacauugaaaaaggcaaggcaaagaaacugaagacugugaaagagcuugucgggaucaguauaauggaaagauccuuuuucgaggagaaccccguuucuuuucuggaaaagaaaggauaccauaaugugcaggaggauaaguugauuaagcucccaaaauauagccuguucgaauuugagggcgguaggcgacggcuacuggccuccgcuaccgagcuucagaaggggaacgaaguaaugcuccccgcccaccugguggaguugcuguaccaugcacaccgcaucgacucauucaauagcacagaacacuuaaaauacgucagugagcauaagaaagaauuugagaaggugcucucuugcguugagaacuucuccaaccuguauguggaugucgagaaaaaucuuagcaaggugagagcggccgcugaaucgaugacuaacuuuucacuggaagagaucucugccaguuucauuaauuugcucacccugacggcacuaggcgcuccugccgacuuuaacuuccugggagaaaagauaccaaggaaacgguacacauccaccaaggagugucuuagcgcaacucucauccaccaaucuguuacaggccuguaugagacccgaauugauuugagcaaauuaggggaagaguga

SEQ ID NO: 3180 - RNA, 4128 nt, Artificial Sequence
  Cas9 variant
augaccaagaucaaagacgauuacauugugggccuggacauagggacagauagcugcggaugggucgccaugaacuccaauaacgacauccucaaacuucaggguaaaacugcuauuggcucuagacuguucgaagggggaaagucagcagccgaaaggcgguuguuucgcacgacccaccgacguaucaaaagaaggcgguggcgcuuaaagcugcuagaggaguucuuugaucccuauauggcggagguugacccuuacuucuuugcuagacucaaggaaaguggccugagcccacuugauaaaaggaagacaguguccucuauuguauucccgacuucggccgaggacaaaaaguuuuaugaugacuaccccaccaucuaucaucugcgguacaaauugaugacagaggaugaaaaguucgaccuccgcgagguguaucuggcaauacaccauaucauuaaguaccgagguaauuuucuguacaacaccucagucaaagauuucaaggccagcaaaaucgacgugaagaguuccauugaaaaacucaaugaguuauaugagaaccuggggcuugacuugaauguugaauuuaacaucucuaauacugcugagauagaaaaggugcugaaagauaagcaaauuuucaagagagacaaagucaagaaaaucgcagagcuauuugccauuaagacagauaacaaagaacagagcaagaggaucaaggacaucuccaaacagguggcuaaugccguacucggauacaagacccgguucgauacgauugcgcugaaagagauaucaaaggacgagcuuagugauuggaacuucaaacugagcgacaucgaugcagacucuaaguuugaagccuugaugggcaaucucgaugagaacgaacaggcuauucuguuaacuaucaaggagcuguucaaugaaguuacccucaacggcauaguggaggacgggaacacacuuuccgagucaaugauuaauaaauauaacgaccaccgugaugaccugaaguugcuaaaagaagucaucgagaaucauaucgaucgcaagaaagccaaggaacuggcacucgcuuacgaccuguaugugaacaauagacacggacaacuucugcaggccaagaaaaaguuggguaaaauuaagccuaggagcaaagaggauuuuuacaagguggucaacaaaaaucucgacgauagucgggcgucuaaggaaaucaagaaaaagauugagcuggacuccuucaugccaaaacagcgaacuaacgccaauggcguuauacccuaucaguuacaacagcuggagcuagauaagaucauugaaaaccagagcaaauacuacccuuuucucaaggagaucaauccagugucgucucaccugaaggaagcacccuauaaacuugacgaguugauccgcuucagaguaccuuacuauguggggccacugauuuccccgaacgagucaaccaaggauauacagacuaaaaagaaucaaaacuuugcuuggaugaucaggaaagaagagggacggauuacccccuggaauuucgaccagaaggucgaucgcaucgaaagugccaacaaguuuauuaaaagaaugacgacuaaggacacauaccucuucggcgaggacgugcugccugcuaacagccuucuguaucagaaauuuaccguuuugaaugaacucaacaauaucaggauaaacgguaagcguaucuccguggaucugaaacaagagauuuacgagaauuuauucaagaagcauacuacagucaccgugaaaaagcuggaaaacuaucuaaaagagaaucacaaccucguaaagguugaaaucaaagggcuggccgacgagaagaaauuuaauucuggacuuacgaccuacaaccgguucaagaauuugaacauuuucgauaaucagaucgacgaucugaaguaccgaaacgacuuugaaaagauaauugaguggagcacaaucuucgaggauaagucaauuuauaaagaaaagcucagaaguaucgacuggcugaaugagaaacagauaaacgcauuauccaacaucaggcugcagggcuggggccgccuuagcaagaaguugcucgcccaacugcaugaucacaaugggcagacuauuaucgaacagcuaugggacucucagaacaauuuuaugcaaauugugacccaggcugauuucaaagacgcgaucgcaaaggccaaccagaaucugcucgucgcuacaucaguggaggauauacugaacaaugccuacacaaguccagcaaacaaaaaggccauucggcaggucaucaaagugguugacgacaucgugaaggcugccagcggaaagguacccaaacaaauugcaaucgaauuuaccagagaugcggacgagaauccuaagaggucccagacacgcgguucuaaacuucagaaggucuauaaagauuugucgaccgagcuggcuagcaagacuauugccgaagaguuaaacgaagcaauaaaggacaaaaagcucgugcaggauaaauacuaucuguacuucaugcaacuuggccgagacgccuauacgggggagccaaucaauauugaugagauccagaaguacgacauugaucacauccugccccaguccuuuauaaaagacgaugcuuuggacaaccggguucucgugucacgugccgucaauaacggaaagagugacaaugugccgguaaagcuguucggcaacgaaauggcagcuaaccuagguaugacaaucagaaaaaugugggaggaauggaagaauauugggcugaucucuaaaaccaaguacaacaaucuccugacugauccugaccauauuaacaaauauaagagcgccggcuuuaucaggcgccaacuuguggagaccucccagauaauuaaauugguuucaacaauccugcagagccgguaccccaauaccgaaaucauuacugucaaggcgaaguauaaccacuacuuaagagagaaauucgaucucuauaagucuagggaggugaaugacuaccaucacgccauagaugcuuaucuguccgcaaucuguggaaaccuucuguaccagaauuacccaaaccuacgacccuuuuucguguauggccaauacaaaaaguuuaguagcgacccugauaaagaaaaggccauuuucaauaagacacgcaaauucucuuuuaucucccagcuccugaagaacaaaucagagaauaguaaggaaauugcuaaaaaguugaagcgggccuaucaguucaaauacaugcuggucagcagagagacggaaaccagggaccaggagauguuuaagaugacuguuuauccacguuucucgcaugauacagugaaagcaccccgcaacuuaaucccuaagaaaauggggauguccccagacauauacggagguuauaccaauaacucugaugcguacauggugaucguacggauugacaagaagaaaggcacagaguacaagauccucgggauuccgacuagagaacuggucaaucuuaaaaaggccgagaaagaagaucacuauaagagcuaccugaaagagaucuugacccccaggauacucuauaacaagaacggaaagcgagacaaaaagauuacgucauuugaaaucgugaaaaguaagaucccuuacaaacaaguuauucaggacggcgauaagaaguucaugcuggguuccucuaccuauguguacaaugcuaaacagcuaacacugagcacugaguccaugaaggccaucaccaacaauuuugacaaagauucagacgagaacgaugcacuuauaaaggcuuaugacgaaauucucgauaaagucgacaaguaccugccauuguucgauaucaauaaguuucgggagaaacugcacagcgggcgcgaaaaguucauuaaauuaagucucgaggacaagaaagauacaauccugaaggugcuugagggccugcaugacaacgccguuaugacuaagauacccaccauuggauugucuacgccucucggcuuuaugcaguucccaaauggggugauccuguccgaaaacgcaaaacuaaucuaccaaagccccacaggacuguucaagaaaucgguaaagauuucagaucuuuga

SEQ ID NO: 3181 - RNA, 4131 nt, Artificial Sequence
  Cas9 variant
augagcaacuucgacaaucacaaggauuccaucugcaaacauaagggccugaaaaaggggaacuacuauauuggacucgacauagguaccaauucugugggcugggccgcuacaaacgagcaguacgaacuucugaaauuuaagucacacaagaugugggggaguagauuguucgcagaggcccaaacugcggucgauacgaggaugaaacggagcgcucgccgacguuuacagagaaggaaguuucggcugauccuacucgaaucccuguucucuaaagagauuaaugccguugacgaaaccuuuuucaugcgccuucaugagucgaacuaucacguggaggauaagacaaaucugguaaaauacacuuuguuuaucgacaagaacuauaccgauguggacuacuauaaggaguuccccacaauuuaccaucucagacaccaccugaugaccgaaggaacuaaagauaucaggcugcucuuuuuagcaauacaucacauccugaaguaccggggcaauuuccuuuaugguaaaaaggaauuuucagucgacggggagauguacagcguguugcgcaguacacuggaggaacuaggauucggcuccuauguugaggaugaaaacgugcuccagucuauugccaaucugguccuugaccgaggcaucgcuagaagcgagaaagugaagcagauugaaccucugaucgcacaagggaaaaaguuguccucaguagagaagaacaggcucaaagccugggcuuaccugauaaugggauuaaaggccaaucugguuaaccucuuuaccgaugaggacguggaagucgugcuuccagaggaaaaagaguucaagaguauuaaucugcaugaagguaucuaugaggacgugcgggaugcguacgaggacgcauggggcgaucguuucgccauugucgaccaguguaaaguuuugcacgauaucaucgugauuagcucuauaaucaagccggggcagucccuaucagaagcuaagauugagagcuauaaccagcacaaagaagaccugguacuccugaagagugugcuuaaagaggauaagaaacuguacgacgauauguuugucguggacaucgauaagggaacgaacuacguuaaguauauaaaacaaggcgugaaugguaacacuucuaccacacaggaagccuucuacaaguauguccgcaaagugguauccguuuugcccgagacugagaauaccagaugcauugugcagaagcucgaagaggggacauuucugccuuuacagaggaucagcaaaaacggagucgugccauaccaacugcauaaggaggagcuaguccggauccucgaaaaggcaaaacugaauuuccccuuucuuaacgaaguggaggacggcuugaccguugcugacaagauuaucucgauucuggaguucaaaauaccuuauuacgugggcccacucaaucccacgcacucuaucgaaaacgggggauuugccuggguaguccgaaaggaagcgggucaggugcugccuuggaauuucgagcagaaaguugaugugcaagccuccgcagucaaguuuauugagaaccuuacuaauaaauguacauaucugaucgaccaggauguguugccaaaguacucacuccuguacgcugaguucaguuuacugaacgaacuaaauaacauccgcguaaaugacaagccgcuccccgccgaugugaaacaggcuuuuauuagagaccauuucauaagccugcaggauuccaagaccgccacuaaaaagguugucgcaaaauaucuuguggacaacaacuacgugucucaaccuccaaucauuacaggcauggaucagcagaucgccaccaaguugacgagccacagggacaugacccggauucugggggaacauuuugauuaugcuauggcggaggacaucauacgcuacaucacaauuuucggagaaucaaaggauaugcucagacagguccugaaaaauuauuacggcgacagguuaacuaccgagcaaaucaagaaacuggguaaacuuacauauacuggguggggccguuugaguaagaaguuccucuccgacauuuggggaaugaagaaaaacgaugacgaugcagaggccggcaccaucauagaacacaugcgggaggggcaggaaaaucugaugcagcuacugucuagcucauacaguuuuauugacguugugcaggaguacgugacaaacguacucggagcuaaggagaaaaccgccuucgaaaugcuggaggaucuuagcuugucccccauggucaagcgaucuguguggcaaacucugagaaucuuagacgaaauuguuucgaucaggaaagagcucccuaagaagauauuuguggaagucgcacgcacgaauaaagccgauaagaaacggacacagagcagaaaggcucugcuugaggagcuguaugaacagaucaaagacgaggaugugcacguuuugcagcaagaacucgaguccaaggaagacucagcccugaacaguaaaaagcuauaccuguauuucacccagauggguaggugcauguacucuggccgccgaauugauauccaugagcucuuuacugacaccuaugauauugaccacaucuacccacggagccugacaaaggacgauuccuggcauaauauagugcuuguagagaaacaguugaacgcagaaaagaccgaccguuuccccauucugucagcgauccaaagcaaacagaagggguuuuggaaauuacucugggauagaggauucaucucugagaagaaguaugacaggcugguccgcacuacagaucuuacggacgaggaacugaaucaguuuauuaaccggcagaucguguccaccaaucaaagugugaaagcugucacuacacuacuccaccagcuguacccggaaaccgagguuguguucagcaaggccgagaacauuucugauuuuagaagggacuacggcuucguaaaagugcgauccauaaaucaccaucaccaugcaaaggaugccuauuugaacaucgucguggguaauguuuaccacgaaaaauuuacaaagaacuuccugucauucgcuaagcagaaagggacucaucgcaccuauaacuuaacgaagauguuugaguacgaaauuaaacucaccgaggaaaguaagaaagugaucugggacccuaauauucacauggauaucgucaagaagaugaugaaaagcaacgacgugcggguuacacagagagccgugccccaaaagggcggacugucggacgagacuauauauaaaaagggcaucgcaaaacguggggucuaccuuccacugaaguccucugaugagaggguacgcgacguggaaaaguauggaggucggaccagcauuacaaucucagaguacauuaucuugaauauaagagauaccagugaccaggauaggauugaaaucuucucccucccucuguacaucgcuggcaaaaaggacauucacaaagccauagaggaggcguaucuaucuacuuguaagaaacccgccagcguuguggauauccagauucuguaccgagggcuuuauaucggauccaaggucaacauuaauggcuuuacguacuauaugggugggaaaacaggcucaaacgugagcguagacagugcuguggaugucguuauggacaucaccucuuccguguacauaaagcuccuggaaaagguggcaaucaaaaagauugagaauagcaaaacuuuccggaucgaaaacauuaagacaucguauaaucauaaagaggucaccgugucaaaggaacagaacaucgccuuguaccaagagcuguuaaagaaacucgauacuccacuguuuucuaagaugaaaggaaauaaacuugaggaguuccgcaccguuggcuuugacacauucauagcucugaguuuggaagaucaggccuccguacuccuggaagugcuaaacguccugacgaauuuuaagaccaagagagacauuacuaagaucgggaugacaagcucuaggagcacccuuggaaucaacauuuccaauacagagcaguucucagugaucacuaccaguauaacgggccucuacgaacaagagauuaaaaucaaguga

SEQ ID NO: 3182 - RNA, 4131 nt, Artificial Sequence
  Cas9 variant
augaccacaaagaacagagagaaaaauaacaaguuccacaaagccagcccccuguacacucucggccuugacaucgggacgaccuccgugggauuuacagcuauugaugaagcacagaggccuaugcgggccaaggguaaaacugucauaggcguucgccuguuccaagaggggcagucugcggugggacgaaagaauuuucguaccacaagaaggcgguugaagcgcagaaggcggcgcuuaaaccugcuaaaacaguucuuuucagcuccacuccgaaagaucgacccgaccuucuuuaaaagacugaaggccaguagccuuucccccgcagauaaaaggcgguaucuggccccuggcuuguucccaaaugguggggacauuaaguuuuaccagaaguaucccacuaucuaccaucuccgucuggcucugaugacagaaaaacgcccuuucgaucucagagagguauauuuagcaauucaccauaucgugaaguacaggggaaacuuucugaauccacuucccgucucugccuuccggggccgaaaccaacgcuuugaagaccaguucucggaguugaaucagcuguauaaaucacuagagggcgaaagcccuuuccaguuugaugagaagauauucagugaacucgacaaacaacugcuugugaacgaugggagaaagaucgacaggcagaaacagcuggcuaagcggguuuuuauuaagaccaaugagaaacgcaucgauucccaccaucagaagauugccucugcguucagcaaagcaguguuuggauacaaguucagaccagacgucuugcucaacuccgauccgaaugagucaaucgacgaauuuauaaaauucggugacgaggauuuugacgauaagcuggugauuuuaagggaaagucugaacgccacgcaaaaggagauccucgcuguaacucagcguauuuacagccagaucauccuuaaugaaauuguucccucucgggagacccuguccgaggccauggugucacgauaucaaaaacaccacagcgacuugcagcuacugacagaagcaugcaagaaaaugacuaaggcuaaagccgcgagaauacaggccgcauacaccgauuauaucggcaagggggacggacauaagcucguccacgaucaguucguggcucugauuaaaaagaaccuugacccuagugaggaaggcagggaucuggccgagcgcuuggcucaagacgauuuuaugccacuccagcggacaccccugaacagagugaucccucaucaguuacagcaagaagaacuggacaggauaauugagaaucagggugaauacuauccauuccuaaaaacccucaaccccaaucgcucucgagccggggucgcaaacuaccagcuggacgagcuuguuuccuuucggaucccguauuacgugggaccuuugaucacggccacugaucagcugcacacaagcggcgcuaaguucgcguggaugacccguagagcagccggcgaaauuacucccuggaauuucgaccaaaaaguagauaggcucgcuucggccaaccaguuuauccgccagaauaugccaaaggacaaccaucugcuugaggcagaugugcugccugccaauucuuugacauaccagcgguaucucguccuggacgaauuaaacgcugugaagguuaaucacaaaucccugaccgugucacaaaagcagagaauuuucaacgaucuauuuaaaaggcagcgaacggucaccgugcucaaucugcaaaacuaccuuaagaguauagagaaauugcccacacugccaguaaucacugggguuagcgacuccgagcgcuucaagaccacacucucuacuuaucuggauuuuaaaaauauuuucggagguaagguggacgauagcucacagaaggaaaaauuugagaagaucaucuuauacgccaccauuuucgaagaccacgcagucuauaaagcgaagcuggaucagauagacuggcuuggccagcaacagaaaacagacuugcucaguaagaacuaccagggguggggacagcuguccgagaagcuacugcucggccugaaaaaccaagcuggucagagcauccuugaugaguuguggcagaccaauaagcgguuuagagaaauuaugaacgaggcccauuucgcaaaacagaucauggccucuaaugcugcccuguuaaggaagaaagggcucgacgaugugcugucaacugcauuucuuaguccccaaaacaagaaggcuauucgucagacggucgaagugguugacgauaucgugaaagccauaggcuguccuccacagaagaucagccugcacuucuccaaagcgccggccgacgcuauucgccaugagcgggauaaugcaaacaucauuuugagaacauauaggaaucuccccgccaagaugguagacgaucaacugaaagcugaacuacaggccaccgcagagaagcaccagguccugucugacaagcucuaccuguacuuuacucagcuuggacgagauuuguauaccggcgagaugcugaaaaugucggaauuagagaacgacaugaucgaucacauaaugccucaaacauucgcguacgacgacagcgugaauaaccggguucucgugucccagaaucauucaagucagcuggggaagaccucuggagaaaaaucugaugccaagaugauucgcuucuggcagguccuuagagacaacaaacugaucuccgagcaaaaguaucagaaucuaacucucgauucagaccaccugagcaaaucuacaagggaacaguugcugaaccgguacuuaguggagaagaauccaauuacgcaguggguagcuuccgugcucaccgagaaguauggugauaacggcacucgaguucugacaaucaaccccagaauggucuaccaaaugcgcaggcaguuuaaucuugugaaccugccugaagugaaugacuaugaucauggguuggacgccuaccucgcagcuuucauaggaaacuacgucgaucgucgguauccaagacugaggaguuacuuuguuuauggcgacuucagcagcuccaaagagaucguguuucgccuaaaucgauucaacuuucuguucgaucuuggucaggccgaacccaaugagcucaccgacugggaaacaggggagaugauuugggacaaggcagccgcuaacucagugcugagagauguauaccaguauaaauuuauguugaucagucaagcggucuacagccggcagggcgccauguucaaucagacuauuuauccggcaucgcaagcugccggaaggcagcugaucccugugaagaaaaaccgcgccaccaaguuauacggcggguacuccggaaauguugacgcuuaucucgcaauagugcgucuggguggcccaaagucugaucaguacagagucguggggauucccacgcggaugguuggaaggcuucagagcgccaugaaacaaggcgcggacaccuaugcuaacacacugcacaagaucuugcagccucaguuuacuaaacgcaagaaaaaucgacagaccgguuacuaugaggaaacaacugagcccuucgccgugauccucgauaagguauacuauagacaacugauuaucgacgggcagcagaaguucaugcuaggcucaaguaccuaccaguuuaacgcaaaacaacugguccuuuccucucgggccaggcagauucucagcggagaggagcgccugacggaugagaauggcucccaggacuugauagauguguacgacgaaaucuuaacaaagauugauagauauuucgagcuguacgaccaaaggcacuuucggcagucacuccaugaugggcguaaacaguucaucagccugccaauucacaacguguaucgcgcuaaccgacuuaucgaacauggaaaguacgagacccugagucagauauugaauggccuacacgcaaacacuaugaugacaaaucugagauaucucgguaucucuuccccuuuugggaaauuccaaagccccaacggaauuaagcugucgaaggacgccguccuuguuuaccagucaccaucuggcuuauuugaaaggcgggugcgccugagagaccucuga

SEQ ID NO: 3183 - RNA, 4131 nt, Artificial Sequence
  Cas9 variant
augaacaauaagcccuacagcaucggccuggacauugggaccaacuccgugggaugggccgucauaacagaugacuauaaaguuccuucuaagaaaaugaaggugcucgguaauacugauaaacacuucaucaagaagaaccuucugggcgcuuuguuauuugacgaggggacgaccgcagaagauagaaggcugaaacggacagcccgccgacguuacacuagaaggaagaaucggcuacgcuaucuccaggagauuuucaccgaagagaugucaaaaguagacaucagcuuuuuccauagacuggaugacaguuuucuugugccagaagauaagaggggauccaaauacccgauuuucgcgacacuggaggaggaaaaggaguaucacaagaacuuucccaccaucuaccauuugcggaaacaccucgcugacucuaaggaaaaagccgauuuccgccugauauaucuggcacucgcccauaucauuaaguaccgaggccacuuuuuauacgaggagucguucgacaucaaaaauaacgauauucaaaagaucuuuaaugaguucauaucaauuuaugacaacacuuuugaagguagcagucugaaugggcagaacgcucaggucgaagcaaucuucacagacaaaauuuccaagucugccaagagagagagggugcuuaaauuguucccugaugaaaagagcaccggacuguuuuccgaguuccuaaaacucaucguuggcaaucaggcugacuuuaagaaacacuucgaucuggaggaaaaggccccacuucaauuuucaaaggacacguacgaugaggaccuggaaaacuugcucgugcagaucggcgaugacuucgcggaucuguuuuuagucgcuaaaaagcuguaugacgccauucuccuuagugggauacugacugugaccgaucccagcacaaaagcuccuuugucugccuccaugaucgaccgguacgagaaucaucagaaggaccuagcagcucugaaacaguucauuaagacuaaccucccagaaaaguaugaugagguauuuucagaccaaagcaaagauggauacgccgguuauaucgacggcaagaccacacaggaggcguucuacaaauacauaaagaaccugcuuaguaaacuggaaggggccgauuacuuuuuggacaagauugagcgugaagauuuccuccgcaagcagagaaccuuugacaauggaucuaucccccaccagauccaucugcaagagaugaacgcaauuaucaggcggcagggcgaacacuauccuuucuuacaggagaauaaagagaagauugaaaagauacugacguuccgaaucccauauuacguugguccgcuagcucgcgggaacagagauuuugccuggcucacuaggaacuccgaccaagcuauucggcccuggaauuucgaggaaaucguggauaaggcccgcagcgcagaggacuuuaucaauaaaaugacaaacuaugaucuguaccuuccugaggaaaaggucuugccaaaacacucgcugcucuaugagaccuucgccguguacaaugaacugacuaaggugaaguuuauugcugagggacuuagagacuaccaguuccuggacucuggccagaaacagcaaauagucacacaguuguuuaaggagaaaaggaagguuaccgaaaaagauaucauucaguaucuccauaacguggacuccuacgauggcaucgagcugaaggggauugaaaagcaguucaaugcgucauuaaguacguaucacgaccugcuaaaaaucauaaaggauaaagaguuuauggacgauagcaagaacgaagcaauccucgagaauauuguacauacccugacaaucuucgaagaccgugagaugauuaaacaacggcuugcccacuacgcuuccaucuuugaugagaaggugauaaaggccuugacucgaagacauuauaccggaugggguaaacugucugcaaagcucauuaacggcaucuacgacaaacagagcaagaaaacaauucuggauuauuuaaucgacgauggggaaauaaauaggaacuucaugcagcugaucaacgacgacggacuuucauuuaaggagauuauccagaaggcccaagucgugggcaaaacuaaugauguuaaacaggugguccaggaauugcccgguaguccugcuauuaaaaaggggauccuccaguccauaaaacugguggacgagcuaguaaagguuaugggccacgccccagaaagcauugugaucgagauggcacgcgagaaccaaaccacagcgcggggaaagaaaaauucucagcagagauacaagaggaucgaagaugcucugaaaaaccucgcccacggccuggacucaaauauucuuaaggagcaucccaccgauaacauccaauugcagaaugaccgccuguucuuauacuaucuccagaacgggaaagauauguacacuggaaagagucuggacauuaaucagcuuagcuccugcgauauagaccacaucauuccgcaagcauucaucaaagaugacucucuggacaaccgagucuugacgucgagcaaggauaaucgggguaaguccgacaacgugccuucacucgaaauuguccagaaacguaaggccuuuuggcagcagcugcuagauaguaaacugaucucugagagaaaguucaauaaccucacaaaagcugagaggggcgggcuggacgaacgcgauaaggugggauuuauaaagcggcaacuuguugagaccagacagaucacuaaacauguggcccagauuuuggacgcaagguucaauaccgaaguaacagagaaggauaaaaaggaccgaagcgucaaaaucauuacccugaaguccaacuuagugucaaacuuucgcaaggaguuccggcucuauaaaguuagagaaaucaaugauuaccaccacgcucaugaccccuaucugaacgccguggucgcgaaggccauacuuaaaaaguacccaaaacuggagccugaauuuguguauggcgauuaccagaaguacgaccuaaagagguauauuagccguacuaaagaucccaaggagguagaaaaagcuacagagaaguacuucuuuuauucuaaucuccugaacuucuuuaaagaagaggugcacuacgcagacgguacgaucguuaagcgcgagaauaucgaauauuccaaagacaccggggagauugccuggaacaaggaaaaggauuucgcuacuaucaaaaaggucuugagucugccacaagugaauauagugaaaaagacagaggaacagaccgucggccagaacggaggcuuauucgacaauaacauuguuagcaaaaagaaggugguggaugccucuaaacucacacccaucaaguccgggcugucaccugagaaauacggagguuaugcacggccaacuauugcguacaguguacuugucaucgccgacauagagaagggcaaagcuaagaagcugaaaagaaucaaggaaaugguggggauuaccguucaagauaaaaagaaauuugaggccaauccgaucgcauacuuggaagaguguggauauaagaacauuaaucccaaccucaucauaaagcugccuaaauacagccuauucgaguuuaauaacggccagaggcgacugcuugcuucguccauugaacuccagaaggguaacgagcugaucgugccauaucauuucacggccuugcuguaccacgcacagcggaucaauaaaauuucugaacccauccauaagcaauaugucgagacccaccagagcgaauuuaaagaguuacucacagccauaauuucacugaguaagaaauacauccagaagccuaacguggagucccuucugcagcaagcauucgaccagucugauaaggacauuuaucaguugagcgaauccuuuaucucacuccugaaacuaauuagcuucggggcgccaggcacuuuuaaguuccugggaguugagauaagucagucuaaugugcgcuaccaauccguaagcucgugcuuuaacgccacccuuauccaccagucaaucacaggccucuacgaaacuagaauugaucugucuaaauugggggaggacuga

SEQ ID NO: 3184 - RNA, 4131 nt, Artificial Sequence
  Cas9 variant
auggacaagaaauacggcaucgggcuggauauuggaaccagcuccauagguuggacaguggucgacaaguauggccacaucauuagaguuaaagggcagacuggaaucggcgugaggcucuuucgggagggucaaacggccgcugaacgccgaaccuuucguacaacuagaaggcggcuuucucgcagaagguggcggcugcgcuuguuacgagagauuuucgaugaacccaucucagcaauagacgagaacuuuuucgccagacagaaggcgaguagccuggcuccuggggaugccagguaccagcaggcauuucaacuauucaaugaccggaccgaucaggccuuuuauugcaaauacccaacaaucuaucaucuccgucaggcucugaugaccgaaucccgccaguucgacauuagagagaucuaccuugcacugcaccaaauuaucaaguauaggggacauuuucuucucggcggcgccgcuaaggauuuccagucugacaaacuggaucuggaggccuacuuuacuacaauaaacgcgcagcucgcagggauuuacucggacggaucaguacaguuaccgacccuggauuggaaucaagccugucaggaacuuacggacacuagccggacccagagugaccgaaagaacugguuggugaaagagcugaaguccuauggugauucucaacuaaaacccaucuacacacagauugcuaaugccauccucggcuucaagacugaccuggcaaagaucauggggauuaacgauccugaaaaagcucuuagcuuuaaucuggacgccuuggaugaccaccgcgaugacgucgcggagcuccugaccgaugagcagauaccauuagugaaccugcucgccaaguugcauacagcacuggaauuggcugccauccuacccgacggacagacccuguccggcaaaaugguugagauuuaugaaacgcacagaaagcaacucaaaacuuacaaggcuuucaucaggcagcugccugaucggcagcagcgccuugcccugaaacaagcauaugaccacuacauagaccaggguuugaauagagaggccuucuauucagaagugaaggcuauucucgagaagcagaaaccacugacagcgaccgggcaggcaaugaagaaagccauggaucaaaacgcuuucuuacugaagcagaggacuaaaacaaauaucgccauccccuaccagguccagcaacaggagauggaccagauuaucgcaaaccaaaguaaguacuauccuuggcuagccaccccaaauccgguaaagagccgucgggugauugcucccuacaaacucgaugaacugguuugcuuccgagugaacuauuacgucggaccucuugugcagucuaagccaggcgaggccacgaaagaagcaaaguuugcguggaugaccagaaaagacccccaguccacaguggcuauaacuccuuggaauuucgaucagcaagucgacaggcaggccucagcaaacgccuuuauccagcgcaugaagaccacagauacuuauuugcugggcgaggacguuauuccaaagaacagccuccuguaccagaaauaugaagugcuuaaugagcugaacaauguacgggugaacggggauugguuggacccccaaagaaagcaguaccucuucaaaaagcuguuuauggaucagccgcagagugucgugaccguuaaggcuuuacaaaagacacugguggucaucggagccuguccuacccuacccacuguggagggucucgcaaauccaaagagguuccugucucagcuuacgacauaccaugacuuuugcaaauugcugccugaugacauccagcgcgcugaccgacaagccgauauugaaaagauaaucaacugguccaccauuuucgaggacacugcgaucuuuaaagaaaagcuccgggauauuaaauggcugagcgccgaccagauccguagauuaucgucuaggccccgcuaucggggcugggggagauucuccgcuaagcugcuuuguggauugcacgauaggcagggcaauaccguaauggacgagcucuggcagacaucacgaaacuuuaugcaaauaauccgccagagugauuuccagaccgcaauugccgcuguuaaucagcaagaccugggucggcaggaucuacagagagugaucgacgaucuguacacuagcccacagaacaaaaaggccauuaggcaaguccucgcaguggucacagacauccagaaggcgaugcaugggaaagcccccuccuggcuguucguggaaguugcuaagggcgcccagaaaaauccucagcguacgcaaucucgccagagcaaacuugcagaggcuuaucgggagucagccagagaauugguggaugaggcaguaaaagaacagcuguuaacccucccagacgacaggcaaacuuuuagugaucgacugguccuuuacuuccagcagaacggacgggacauauauacaggcgagccgcuggauuuugagcgcuuguccaauuaccacauugaccacaucauuccccaggccgugguuaaggaugacagccucgauaacagagugcugaccucuaaucaagcuaaccuagaaaagggggcgcaugucccuacaaucuucagggacaaacaggagccaguguggcaggaacuguaucggguaggacucauaucacaccgaaagcugagaaaccuuuugacuacccccgaugaccuggaugaccgcgguagggccacgggcuuuaucgcacgucaguuaguggagacccggcaaguuauuaaacucgucauggaagugcugagucaguacuacgacacaacugagaccgagcuuaucagcauuaaggcugggcugucccaucaguucagacaggaacuaaaucucccuaaacugagggccuugaacgauuaucaccaugcccaagacgcuuaccuggcagcccgcaucggaacauauuuacuccagcgauacccaaaucugaagagauuuuucguguauggcgauuuuaagaaaacucacuucgaccuucagcggagguuuaacuucauaggugggaugauuucucgcgagaagcaacccuacaaucugaucaaaaacccggucacccaccagguuaucugggaugaagagauggaaauuggcgacugccagaagaaaaauccugagcagccaaagcaugaugcgacggugaagaugaugaacuugacaaaaaucaugaaucucaagcacauucuggugacccaugagguauaugaaaaccacggagcucuauuuaaucaaacuauauaccccgccucgcaggcacacaaaaagaaacugaucccucagaagacagagaaacccauugaacuuuacggcgggcauagcuccgagcaggccggauauauggcuaucauucgucuccuggguaagagaccaggcuacaaggucaugcgggugccuguuagguaugugucacaauugcagcaccaggacgucgcagaacagaaaaagcuguuauacaaaaucuucgugagugagcucaccucucgcaacaagguuaaacccuucgaggugguagucccacaugugugucugaaucaaccgguggaagauaugauaaaggggcaguggcaccgauuugcccuuagaacuaacggauauuaccagaaucagcaacagcugaucuugagccucgucgcgcagcggacccuggcuggcuauaagccuaaagacgaugagcuaauggccguuuaccaugaaauuugcaagcaagugaaauacuauuucccccuguacaagaugaacaaauuucaguccaggcuuuucgcagccgaggagcuccugcagaagcgcucaacaguaaacagcuuuucuaucacgauugguaagaaugggaaagaaaacaagaccuugaauuuaggcaaaagagagcugcuccugaggcuucugggaggcuugcacgcuaacgccacucggguggaccuaaaggauaucggguguacaggacaguucggccaacugcaggucaaaaaugguauaaagcucaccgaacaggcagugcugauucacgaguccccaacagggcuuuuucaucgucgcguucgauuaaacgaccuguga

SEQ ID NO: 3185 - RNA, 4134 nt, Artificial Sequence
  Cas9 variant
augaccaagaaaaacuacagcaucggccuggacauugggacaaauuccgugggaugggccgucauaacugaugacuauaagguucccgcuaaaaagaugaaagugcucgguaacacggauaagaaguacaucaaaaagaaucuucugggcgcauuguuauucgacucuggggagaccgccgaagcgacaagacugaaaaggacugcucggcgccgauauacccguagaaagaacaggcuacgguaccuccaggagauuuuugccgaagagaugacaaaaguagaugaaucauucuuuuaucgccuggacgagaguuuccuuaccacugaugagaaggacuuugaaagacacccuaucuucggaaauaaggcagaugagauuaaauaccaucaagaauuuccaacaaucuaucaccugaggaagcauuuggccgacagcuccgagaaagcugaucuccggcugguguaccuggcacucgcccacaugauaaaguuccgcggccacuuuuuaaucgagggugaacugaacgcugagaauaccgacguccagaaaauuuucgccgauuuuguggggguuuacgaccgaacguucgacgauucucaccuuucggaaaucacuguggacgcggcaucaauuuugaccgagaagaucagcaaaaguagaaggcuggaaaaccuaauaaaguauuacccgacagagaagaaaaauacucucuuuggaaaccugauugcccuugcucugggcuugcagcccaauuucaagaugaacuucaaacucuccgaggaugccaagcugcaguuuucuaaagacagcuauaaugaagauuuagaggaacugcucggcaagaucggggacgauuacgcagaccuuuucaccuccgcuaagaaccuguaugaugccauuuugcuaucaggaauccugacagucgacgauaauaguaccaaagcgccucucagcgccucuaugaucaagcgguacgcagagcaccaugaagaccuggagaaacuuaaggaguuuauuaaagcuaacaaguccgaacuguaucacgacauauucaaggaugagacgaaaaacgguuacgccggcuacaucgaaaauggggugaagcaagacgaguuuuauaaauacuugaagaacacucucucaaaaauugcuggaagcgauuauuuccuggacaagaucgaacgugaggacuuuuuacgcaagcagagaacauucgauaauggcaguauaccacaucagauucaucugcaggagaugcacgccauccuaaggcggcaaggugauuacuaucccuuucucaaagaaaaccaggaccgaaucgagaagauucugaccuuccgcaucccuuacuauguagggccacuugcaagaaaagauucuagguuuuccugggccgaauaccauagcgacgagaagauuacucccuggaauuucgauaaaguuauagacaaggagaaaucggcugaaaaguuuaucacacggaugaccuugaacgaucuguaccucccugaggaaaaggugcugccaaaacacucucaugucuaugagacguacgcgguguauaaugaacuuaccaagauuaaauacgugaacgagcagggaaaggacuccuucuucgacucaaauaugaaacaggagaucuuugaucacgucuucaaggaaaaccgcaagguuacaaaagagaagcuguugaauuaucucaacaaagaauuuccggaguacagaaucaaggaccugauuggcuuagauaaagaaaauaagaguuucaacgcaagccugggcacuuaucaugaccuaaagaaaauacucgauaaggccuuucuggacgauaaagugaaugaggagguaaucgaagacauuaucaagacccuuacauuguucgaggauaaagacaugauucacgaaaggcugcaaaaguacuccgauaucuuuacugcugaccagcucaagaaacuggagcgucggcacuacaccggguggggacgauuaucuuauaagcugauaaacgguaucagaaacaaagaaaauaacaagacaauucuugauuacuugaucgacgacggcagcgccaauaggaacuucaugcagcucauuaaugaugacacccugcccuuuaaacaaaucauacagaagucacagguggucggggauguggacgauauugaggcaguugugcaugaccuaccuggaaguccagccaucaaaaagggcauucugcaguccgucaagaucguggaugagcucguaaaaguuaugggugacaaccccgauaauauagugaucgaaauggcucgcgagaaccaaacuacgaaucgggggagaagccagucucagcagaggcugaagaaacuucaaaacucauugaaggaacugggcaguaauauuuuaaacgaggagaaaccuagcuauaucgaagacaaggucgaaaauucccaccuccagaacgaucagcuguuccuuuacuauauucagaauggaaaggacauguacacaggcgacgaacuggauaucgaccauuugucugauuaugacauagaucacauuaucccacaagccuuuaucaaagacgauucgauugacaaccgcgugcucaccagcuccgcaaagaaccgagggaaaucagaugacguccccagucuggauaucgugcgggcgcguaaggcugaguggguuagacuauacaaaucuggacugauuagcaagaggaaguucgacaaucucacuaaagccgaacgcgguggccugaccgaggcagauaaggccggguuuauaaaacggcagcuuguggagacaagacagaucaccaagcacguagcucagauuuuggacgccagguucaacacugaauccgacgagaaugauaaagucauccgagacgugaagguuauuacacugaagucaaacuuagugagccaauuccgcaaagauuuugaguucuacaagguccgggagaucaaugacuaucaucacgcacaugaugcuuaccucaacgccgugguaggaacggcgcugcuuaaaaaguauccgaaacuggccucugaauuuguguacggcgaguauaagaaguacgacguucacaaacuaauagcuaaguccagugaugaccauagcgagauggguaaagcaaccgccaaguauuucuuuuacucuaaucucaugaacuucuuuaaaagagucaucagguacuccaaugggaaggugauugugcguccugucguugaauauucaaaagauacugaggacaucgcuugggauaagaagaguaacuuccgcacaauuugcaaagugcugagcuacccccaggugaauaucguaaagaaagucgaaacccagacaggcggauuuucgaaggaguccauauugccaaaaggcgacucugauaagcugauuccucggaagacuaaaaaggccuauugggacaccaaaaaguacgggggauucgacagccccacgguggcauauucaguuuuuguggucgcggauguggaaaaagguaaggccaagaaauuaaagaccguuaaagagcucgugggcaucaguaucauggagagauccuucuucgaagagaacccaguagaauuucuggagaauaagggguaccacaacauuagggaggacaaacuuauaaagcugcccaaguauucuuuguucgaauuugagggaggcaaacgacggcuccuggcuagcgccuccgaacuacaaaaggguaaugagauggucaucccugggcaccuggugaaacuucucuaccaugcacagcgcauuaacucauucaacagcacaaaguaccuggauuaugugagugcucacaaaaaggaauuugagaaagucuugucuuguguugaggacuucgccaaucuguacguggauguagaaaagaacuuauccaagaucagagcaguggccgacagcauggauaauuuuucgauugaggaaaucucaaacucuuucauaaaucuccugacucuuaccgcucugggcgcgccagccgacuuuaacuucuugggagagaaaaucccgaggaagcgguauacaaguacuaaagaaugccucaaugcaacccugauucaucaguccaucacgggccuauacgagacacgaauugaucugagcaagaucggggaggaauga

SEQ ID NO: 3186 - RNA, 4134 nt, Artificial Sequence
  Cas9 variant
augaagaaacccuacagcaucggccuggacauugggaccaacuccgugggaugggccgucauaacagaugacuauaagguuccuucuaaaaagaugaaagugcucgguaauacugauaagcacuucaucaagaaaaaccuuauuggcgcucuguuguuugacgaggggacgaccgcagaagauagaagguuaaagcggacaucacgccgacguuacacuagaaggaaaaaucggcugcgcuaucuacaggagaucuucagugaagagauuagcaagcucgacuccucuuucuuccauagacuggaugacucguuucuuguaccagaagauaaaaggggaucaaaguacccgaucuucgccacccuggaggaggaaaaggaguaucacaaaaaguuucccacaauauaccauuugcggaaacaccucgcggacagcaaggaaaagaccgaucugcgccugaucuaucucgcuuuagcccauaugauuaaguaccgaggccacuuccuguacgaggagaguuuugacaucaaaaacaaugauauucaaaagaucuucaacgaauuuauauccauuuaugacaauacuuucgaggguucuagccuuuccgggcagaacgcacagguggaagccaucuuuacagacaagauuucaaaaaguaccaagagagagagggucuugaaacuguucagcgaugaaaagucuacgggacuauucuccgaguuucucaaacugaucgugggcaaucaggcugacuucaagaagcacuuugaucuugaggaaaaagcaccucugcaauucucaaaggacacuuacgaugaggacuuggaaaaccuccugggccagaucggggauggauuugccgacuuauuccugguugcuaaaaagcucuaugaugccauucuucugagcgguauauugaccgugacagacccaaguacuaaagcgccccuaucugcauccaugaucgagcgguacgaaaaucaucaggaggaucuggccgcucucaagcaguuuauuaagaacaaucugagcgagaaauaugccgaagucuucucggaccaaucuaaggacggcuacgcaggguuuaucgauggaaaaaccacacaggaggcuuucuauaaguacauuaaaaaccuucuguccaaguuggaaggcgccgacuacuuucucaauaagauagagcgugaagauuuccugcgcaaacagagaaccuuugacaacgguucaaucccucaccagauccauuuacaagagaugaacgcgauucugaggcggcagggggagcacuaucuauuccucaaggaaaaucgagagaaaaucgaaaagauucuggccuuccgcauaccauacuaugugggaccccuugcaagaggcaacagggauuuugcuugguugacgcggaauagugaccaggccauccgcccuuggaacuucgaggagguaguugauaaagcuagcuccgccgaagacuuuauuaauaagaugacuaacuacgaucuguaucucccagaggaaaaagugcugccgaagcacucucuucuguacgagacauucgcagucuauaaugaauugaccaaggugaaauuuaucgccgagggccucagagacuaccaauuccuggauagcgggcagaagaaacagaucgugaaccaguuauuuaaggacaaaaggaaggucacugagaaggauauuauacauuaccugcacaauguugacggauaugacgguaucgaacuaaaaggcauugagaagcaauucaacgcuucacucaguacauaccaugaucugcuuaaaaucauuaaggacaaagaauuuauggauaaucccaagaacggggagaucuuggaaaauauaauccacacccugacgauuuucgaggaccgugagaugaucaagcagcggcucgcgcaguaugauacccuguuugacgaaaaagugauuaaggcauuaacacgaagacauuacacuggauggggcaaacuguccgccaaacuuaucaacgguauaagggauaaacagaccgggaagacaauuuuggaguaucucaucgacgauggcgacugcaaucgcaacuucaugcaacugauuaacgaugacggacugagcuuuaaggaaaucauacagaaagcucagguagugggcaagacugaugacgucaaacaggugguucaagagaucccugggucuccagccauuaagaaaggaauccugcagucaauuaagaucguggacgaacucgucaaagugaugggucacaaucccgagaguauaguaauugagauggcacgggaaaaccagaccacagccaagggcaagaaaaauagccagcaaagauacaagaggaucgaggaugcucugaaaaaccuugccccuggguuggacuccaauauccugaaggaaaacccaaccgauaauauucaguuacagaacgaccgccucuuccuguauuaccuucaaaauggaaaagauauguacacuggcaaggcaaucgacauuaaccagcugucuaauuaugauauagaccacaucauuccccaggcguucaucaaggaugacucguuggauaaccgaguucucacgagcuccaaagacaaucgggguaagucagacaacgugccgaguauugaggucgugcagaaacguaaggcuuuuuggcaacagcugcuagauucuaaacugaucagcgagagaaaguucaauaaccucacaaaggccaaacgcgggggccuggacgaaagggauaaggucggauuuauaaaacggcagcuuguggagaccagacagaucacuaagcauguugcacaauugcuggacaccagguucaacacagaagugaaugaggaaaaccagaaaauucgaaccguaaagaucauuacuuuaaaguccaaucucgucucaaacuuucgcaaagaguucggccuguacaaggugcgggagaucaaugauuaucaccaugcccacgacgcuuaccuuaacgccguuguggcaaaagcuauacugaagaaauauccuaagcuagaacccgaguuugucuacggggauuaucagaaguacgaccucaaaagauacauucuaaagagcaaagccucuaauacaaucgauaaggcgacggaaaaauauuucuuuuacuccaacuugcugaauuucuuuaaggagaaagugagguaugccgacggaaccaucaagaagcgugaaaacauugaguacaguaaugauacuggugagauagcuuggaacaaagaaaaggacuucgcaacaaucaaaaagguauuaagccucccacaggugaauauuguuaaaaagaccgaggaacaaacagucggccagaacgggggacuguucgauaauaacaucgugucuaagaaaaagguggucgacgccuccaaacuuauuccuaucaagucaagucugagccccgagaaauauggcgguuacgcucgcccaacuauagccuauucgguuuuggugaucgcagacauugaaaaggggaagggcaaagcgaagaaacucaagcggaucaaagagauugugggaaucaccauacaggauaagaagaaauuugaguccaaccccguaacguaccuggaagaguguggcuacaagaauauuaacucuaaucuaaucaucaaacugccuaaguauagccuuuucgaauuuaacgacgggcaaagaaggcuccuggccucaaguauugaguugcagaaaggaaaugagcugaucuuaccauaccaccucaccgcucugcuuuaucaugcccagcgaauaaacaagauuuccgaaccgauccacaaacaguacgucgaggcacaucaaaaugaauuuaaggagcuguugacaacuauuaucucucucagcaagaaauauauacagaagcccaacguggaacugcuacugcagcaggcuuuugaucaagccgacaaagauauuuaccagcuuuccgagucauucaucagccuccugaaguugaccaguuuuggcgcaccuggugccuucaaauuuuuagggguugagaucucucaguccagcgugcgguauaagccaaauucgcaguuccuggacacaacucucauucaccaaucaaucaccggacuguacgaaacgcgcauugaucuuucuaagcugggcgaggacuga

SEQ ID NO: 3187 - RNA, 4134 nt, Artificial Sequence
  Cas9 variant
augaacaauaagcccuacagcaucggccuggacauugggaccaacuccgugggauggucugucauaacagaugacuauaaaguuccuucaaagaaaaugaaggugcucgguaauacugauaaaagauucaucaagaagaaccuuauuggcgcccuguuguuugacgaggggacgaccgcugaagcaaggcgguuaaaacgcacagcccgacguagauacacuaggcggaagaaucgccugagauaucuacaggagaucuucgcggaagagaugaguaaaguagauagcuccuuuuuccacaggcucgacgauucuuuucugauuccagaagacaagcggggaucgaaauacccgaucuucgcuacccuuguggaggagaaggaauaucauaagcaauuucccacaauauaccaucugcgcaaacaguuggccgauucaaaggagaaagcagaccuccgacugaucuaucugguccucgcccacaugauuaaguacagaggccacuucuuauacgaagaggcuuuugauaucaaaaacaaugacauucagaagaucuucaacgaguuuauaagcauuuaugauaauaccuucgaagguaguucccugucugggcagaacgcacaaguggagacuaucuuuacagacaaaauuagcaaguccgccaagagggaacggguucuuaaauuguucccugacgagaagucaaccggacuguucagugaauuucuaaaacucaucgugggcaaucaggcugauuucaagaaacauuuugaccuggaggagaaggccccacuucaguucagcaaggauacguacgacgaagaucuggagaacuugcucgaacagaucggcgacgauuuugcggaccuguucgucgcagccaaaaaguuauaugaugcuauucugcucucugggauacuuacugugaccgaccccuccacaaaagccccucugucagcaagcaugaucgagcguuacgaaaaucaccaaaaggauuuggcuguacuaaaacaguuuauuaagacuaaccugccagagaaguauguugagguguucagugaccagucuaaagacggauacgccgguuauaucgauggcaagaccacacaggaagcguuuuacaaauacauaaagaaucuccuguccaaauucgacggggccgauuauuuucuugacaagauugagcgcgaagucuuccugagaaagcaaaggaccuuugauaacggaagcaucccccaccagauccauuugcaggagaugaacacgauucuccggcgacaaggcgaacacuacccuuuccugaaagagaauaaggagaaaaucgaaaagauuuuaacuuuccgcauaccauaucauguggguccgcuggcaagagggaacagggacuuugcuuggcuaacacgcaauucggaucaggccauccggcccuggaacuucgaggaaauuguggacaaggcuucuuccgccgaggauuuuaucaauaagaugaccaacuacgaccucuaucugccugaggaaaaaguccuuccaaagcacucauugcuguacgagacuuucgcaguuuauaaugaacucacaaaggugaaauuuaucgccgagggaaugagagauuaccaguuccuggacaguggccagaagaaaaagauuauaaaccaacuuuuuaaaaagaagaggaaaguaaccgaagaugacaucauugacugccugcagaagaucgauaauuacgacggcauugaguugaaagggaucgagaagcaguucaacgcuagccucuccacguaucacgauauacugaaaaucauucgugacaaggaauuuauggaugaccccaagaauggagauaucuuagagaacgugauucauacccugacaaucuucgaagaccgggagaugauaaaacagcgacuagcgcaauacaauucuauuuuugaugaaaaggucaucaaagcacucagcagaaagcacuauacugguuggggcaaacugucagccaaacuuauugacgggaucagggauaagcagaccggaaaaacaauauuggacuaccugauggaugacggcaagaguaaccgcaauuucaugcagcucaucaaagacgaugagcuguccuuuacugagauuauccagaaggcucaagugguuggugacaccgauaacuuaagacaggugguccagaaccugccugggagcccagccauuaaaaagggcauccuucagucuauaaaaauuguggacgaauugguaaagguuaugggacaugcacccgagucaaucgugaucgaaauggcccgggagaaucaaacaaccgcuaggggcaagaaaaacagucagcagcgcuauaagcgaauugaagauagccucaaaaaucuggccuccgggcuagacucuaacauccugaaggagaauccgacugauaacauucaacuccagaaugaccggcuguuccuuuacuauuugcagaacggaaaagauauguacacgggugaggcacugaauauaaaccaguuaucgagcuacgacaucgaucacauuaucccucaagcguucauuaaggacgacucccucgauaaucguguccugacaucaaguaaggacaacagaggcaaaucugauaaugugcccagccuugaagucguggagaagaugaaggcuuuuuggcagcagcuguuggacuccaagcucaucucagaaaggaaauauaacaaucugaccaaggccgagcgcgagagagggggacuaaacgaacuggauaagguuggcuucauaaaacggcagcucguggagacuaggcaaaucaccaagcauguagcacagauucuggacgcccgauuuaacaaagaagucacagagaagaauaaaaagaaccgcaaugugaagaucauuacccuuaaaagcaacaugguuucuaauuuccggaaggaauuugguuuguacaaagugagagagaucaacgauuaucaccacgcucaugacgccuaccugaaugcagucguggcuaaggccauacucaaaaaguauccaaaguuagagccugaguucguauacggggauuaucagaaauacgaccugaagagguacauuucccguaguaaagaucccaaggaaguggaaaaagcgacugagaaguacuuuuucuauagcaaccuucugaacuuuuucaaagaagagguucacuaugccgacggcacaaucgucaagcgcgagaauaucgaauacucuaaggauacgggagagauugcuuggaauaaagaaaaggacuuugcaaccaucaaaaaggugcuaucccucccacaggugaacauagucaaaaagacugaggaacaaacaguuggccagaaugggggacuguucgacaacaauauugugucaaagaaaaaggugguagaugccaguaaauugauccccauuaagagcggucugucgccugagaaauauggcggguacgcucggccaaccaucgccuauuccgucuuagugacauacaagcagaacaacaagaucaaaaauacuaugguuggaauaccggugcucaccaagcuggaguucgaaagagaccccaaccuuuaccugaggaauuugggcauuaacaaugucucucaugugaucaaacucguuaaguauacggugcuggaguuuaaacacaaguacgguaccuaucgacgguucauuguaagcaaccaagaacuaaagcgcgcaaaucagaucuuugucacaacuaaacagaugaagcugauaucacaguacaccacacuugauaaaaacgagcacgacagucuccugaagaauaaccaacaguugauucaguccaucuggaaucaguuccuggaguuuauguuagcgacugaucucgugaacaaaaagcaauaugacgaacugauccuuaccaauaaccagacgauugaggaauguagaaauaucaugaacagggugauaacaacccugucuuucacuaauauuaacgccgggcagaaaaagaucauuuuugaugacacauugagccucccuaucaagcgguggcaguucaccgauuccgacaaaauggucaagaaaauaauugagucaacucugauccaucaaagcaucaccggccuauacgaaacacgaauugaucugaguaaacuuggagaggacuga

SEQ ID NO: 3188 - RNA, 4134 nt, Artificial Sequence
  Cas9 variant
auggagagcaaccacgacggcgaacaggugaaguacacccuggggcucgauaucggaacauccucuauugguuaugccgcuauagacaaacaucaaaagcccaucagagcaaaaggcaagcacgucauugggguuaggcuuuuccaggagggacagacugccgcggaucggcgcgcuuuucgaacgacccguagaaggcugaaacggcgcaaguggagauugaauuuacugaacaggcuauucgacccuuaccucucagaaguggauccaaauuuucugccgcggcuucgccagaguaaccugagccccaaggacgauaauaaacauuucaacggcuccacauuguuuccugacaagacugaugccgcauucuaucgacaauacccaaccauguaucaccucagauacgcccugaugacagagaaaaggaaguuugacauccgggaaguauaucuggcuauucaucacaucgugaaauaccgugguaauuuccucaacucugcaaccgucgauucguuuaagacuucaaauauagacuucacaagccaguuugaucgcuuaaacgagcuguacagacaggugauccuugacgagcccuuccagauuaauauggaccaaguugaugaaaugaccaacaaguugcuggacaaugaugcccuaaaacucgacacgcagaaacagguggcuaaacugcuuccugucaucuauaacgauaagccaauugacaaacaguacacuaggaucgccaccgaguuuaguaaggcgauacugggguauaaaacaaaguuggaugugauucucaaucuggacacucaaaacgcaaaggauuggguaauccgguuagacgaugaagacauugacgauaaacugcccgcccucguugagaaccuugacgagucccgacaggaaaucgugaccaucauucgcgaucuguacgcucagauaacauugaaugccaucgucccuaagggaaaaucucuaagcgaguccaugguggacaaguauaacgaucacaaagaccaucuggaucuccugaugggccuuauucacgaacugggcgacgauucagcaaaggggaucaaguugagagaggcuuacacccaauaugugggaaaaagugacgauaagacgcucaaucaggacgauuucuacgccgcgauaaagaagaaccuggacgaagacagcaaaaggucuccaaagauucagcgguuaaucgagcaggccuccuucaugccgaagcaacgcacuucagcaaauggugucaucccccaucagcugcaccagcuagagcucgauagaauuaucgaaaaccagggcagguacuauccuuuucugaaaaagccaaaucccaacacacacaaaccuaaugggggaaaguacaaacuugacgaguugguugcuuuccguauuccauauuacgugggcccccugauaaccaagcgggaucaagaaaagacuagcggugccgacuuugcuuggaugauccgaaaaccggggcaggagggagaaauuacaccuuggaacuucgaucagaagguagacagaauggccagugcaaauagguuuauccgccggaugaccacgaaagauucuuaucucguggccgaggacguccugcccgaugcuucccuuaucuacgagaaguucaaagcgcugaacgaauugaauaugcucaaggugaacgacagcagacugucgccaucucagaaacaagauuuauuuaauaaccuguucaagaagcagaaaaccauuaggacaaagaaacuacagacuuauauacgcaccaacugggagcucccuuccguuaugaucucaggccuggcagaccccgauaaguuuaauaguagccuuuccacauacauugacuuccgagacaucuuuggcgaaaaaguggaugacccaaaccggcaggccgauuacgaggaaauuaucgaguggucuacugucuucgaggaccguaagauauaucaagcuaaguugaaucagcuggauuggcucaccgaaccccagagaaaagcccuguuaacaaagagguacaccggguggggacgccugagcaaaaaguuauugacuggucucaaagaccaaaacggcgauucaauccuggaccagcuauggaagacgaaugauaacuuuaugcagauucagagucgggacgaguucgcaaagcaaauccaugaugaaaaugccaaacaguuccacgaggcuaacaauguggacgacauucuggaugacgccuuuacauccccucagaacaagaaagcaaucagacagguagauaagguugugcaagacgucgugaaagcggucggguaugcuccagauaagauagccauugaguucaccaggagccucgaaaauaacccgcagcgaacugugucucgccagcggcagcugcaagcagccuacaagaauauccccagagagauuaugaaaucaggacuuauggcugaauugggcaguguugccgacagcaagaaagugcuguccgauaaguuauaucucuacuuuacccagauggguaaagacauguaugaggauaagacaaucaacauagacaaucugccuaacuacgauaucgaccauauucuuccacaggcauucaucaaagaugacucuauugacaacaggguacugaucucgaaggaagagaaugcucguaagagcaaccgcguccccuugaaauuuuucggggccaagcggaugggcuuuuggaaagaucuccugaauaacggacuaauauccaauagaaaguuccaaaaccugaccacugacccugagaaaauuucaaaguacagugcgaagggcuuuauccacaggcagcucguggaaacaucucagguuauccgacugguggccaauauucuugggaacgaguauagccaggcuggaacgaccaucauugaagucuccgcaaaaaugaaucggcaauugcgcgaggauuuccaucugauaaagaacagaaaugugaacgacuaccaccacgccauggaugcuuauuuaacugccuacguaggugacuaucucuaccugagguauccaaaacuucggcccuacuuuguguacggcgauuucaagaaagcagaagaccaggaucugaauauccgaaacuuuaauuuccuacaugaccucaaggauaacgagucacuggacaagauuguugauagcgagacaggggaaaucgucugggagaaacacggaucugugaagcaguugaaaaagguguaucauuacaaauucaugcuggucucccaggaaguuuauaccagacaagacgcguuauuuaaccagacaauuuacccggccagugacgcugauaagcgcaagcucaucccuauaaagaauagcaagccaguggacguguauggcgguuacucugggaacaucgaugccuauauggcaauuguaaggguccacggcaaaaaggaggacaauuacaaagugguuggaauccccaugcgugcugugacuaagcugaagaaagccgaaaaggagggccacgauuccuaccuuaacgcaguccaugaggugcugaaaccucaguucaccaagaaaaagaaaaaucggaagacgggggaaauuaccgagacaguugacgaauuugauguguugcucggaaagguauauuacagacagcugaucgucgacgguaacaaaaaguucaugcuaggcucaaguagcuaucaauacaaugccaaacagcuggugcuuucggauaaggcuaugcaagugcucuccaaaaacgggaaggucaagucucaggacgagaaucagaaccugauagauguuuaugacgagauuuuggaaaaaguggaccaguacuuugagcuguaugaucagaggcacuaccgcgaaagccuucauaagggacgaggcaucuucguaaaucucccccugucaaaccaauacgacgguaguaaacuuacuuccuaugggaaguacgagaccaucgaugcgauucugaauggcuugcacgccaacgcaacaaugucuaaucucagauaucugggaauaagcuccccauuuggcaaaaugcaggcuucaaacgggcuaacuaucgacccugauagcauuaucugcuaccagagucccaccggacuguucgaacggcagauuaaacuuucugaccucuga

SEQ ID NO: 3189 - RNA, 4134 nt, Artificial Sequence
  Cas9 variant
augaacaagcccuacagcaucggccuggacauugggaccaauuccgugggauggucuauaaucacagaugacuauaaagucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauaggauucuguaccuacaggaaaucuuugcugaggaaaugucaaaaguggacgauaguuucuuucacagacucgaggacagcuuccugguagaagaggauaagcggggcuccaaauauccaauauuugccacuaugcaagaggaaaaguacuaucaugagaaauucccgaccaucuaccaccuucgcaaggaacuggcagacaagaaagagaaggccgauuugcgacucguguaccuggcucuggcacauauuaucaaauuuagaggucacuuccucauugaggacgauagguuugacguccggaacacagacauccagaagcaguaucaggccuucuuagaaauauuugauaccacuuucgagaauaaccaucugcuuucucaaaauguggacguugaagcuauuuugacagauaaaaucucgaagucagccaaaaaggaccguauucuggcgcaguaccccaaccaaaagagcaccgggaucuuugcagaguuccuaaaacucaucgugggaaaucaggccgauuucaagaaacacuuuaaccuggaagacaagacgccucuucaauucgcuaaagauaguuaugacgaggaucuggagaauuugcucggccagauuggcgacgaauuugccgaucuguucuccgucgcaaagaaguuauacgacucugugcugcucagcgggauacuuacuguaaccgaccuguccacaaaagcuccauugucagccaguaugauccagcgcuaugaugagcaccaugaagaccuaaagcaccugaaacaguuuguuaaggcgagccuccccgagaacuacagagaaguguucgccgauucuuccaaagacggauaugcagguuacauugagggcaagacuaaucaagaggcuuuuuacaaguaucugcuuaaacuguugaccaagcaggaagggucagaguacuuccucgaaaagaucaagaacgaggauuuucugaggaaacagcggacauucgacaacggaagcauaccucaucaaguccacuuaaccgaacugcgagccauuauccgcagacagagugaguauuacccauuucuaaaggagaaucaggauaggaucgaaaagauucucacguuccggauccccuauuacgugggcccucuggcucgcgagaaaucugacuuugccuggaugacuagaaagacagaugacuccauuaggccauggaacuucgaagaucuuguggacaaagaaaagagcgcagaggccuucauacaccguaugaccaauaacgauuuguaucugccggaagagaaaguccuccccaagcauucgcugaucuacgaaaaauuuacuguuuacaaugagcuuacaaaggugcgguuccuggcugaagguuuuaaggacuuccaguuuuugaaccgaaaacaaaaggagaccauuuucaauucucucuuuaaagagaagagaaaaguaacggaaaaggacaucaucuccuuccugaacaagguggauggguaugagggaauugcgauaaaaggcaucgaaaagcaguuuaaugcaucauuaaguaccuaccacgaccugaaaaagauucuaggcaaagauuuccucgacaacacagauaaugagcugauccuugaagacauuguccagacuuugacccuguuugaggauagggagaugaucaagaagugccucgacauauauaaagauuucuuuacagaaagccagcugaagaaauuauaccgccggcauuauacuggguggggaagacuguccgccaaacuuaucaacgguauuaggaauaaagagaaccaaaagaccaucuuggacuaccucauugaugacggcucugcuaaucgcaacuucaugcagcugaucaacgaugacgaccugagcuucaagccuauaauugauaaagcccgaacagggucacacagugacaaucuaaaggaagugguuggagagcucgcaggcuccccagccaucaaaaaggguauucugcagagccuuaaaaucguggaugaauuggucaaggugaugggguaugagcccgagcagauaguaguugaaauggcucgggagaaccaaaccacugccaaaggccugucucguucaagacagagguuaacgacacuccgcgaaagucuggcaaaucuuaagagcaacauccuggaggagaagaaaccuaaguacgugaaagaccaggucgaaaaucaucacuuguccgaugaccggcucuuucuguacuaucuacagaacggaagagauauguacaccaagaaagcgcuggacauugauaaucucucucaauaugacaucgaucacauuaucccacaggcuuucauaaaggacgacucgauugauaacagggugcuggucagcuccgccaagaaucgaggcaaaucagacgaugugcccaguaucgagaucguuaaggcacgcaaaauguuuuggaagaaccuuuuggacgccaaacugaugucucagcggaaguacgauaauuuaacuaaggcugaaagagggggacucaccagcgacgauaaagccagguucauucaacgucagcugguggagacacgccagaucaccaagcauguagcacggauucuugacgaaagauuuaacaaugaggucgauaacgguaaaaagauauguaaagugaagaucguuacucugaaguccaaucuagugucaaacuucaggaaagaguuuggcuucuauaagauucgagaagucaacgacuaccaccaugcucacgaugccuaucucaaugcggugguagccaaagcuauccugacaaaguacccgcaguuggagccugaauuuguguacgggauguaucggcagaaaaagcugagcaagauuguucacgaggacaaagaagagaaguacucugaggcaacgcgcaaaauguucuuuuauuccaacuuaaugaauauguucaagagagucgugaggcucgccgauggaaguaucgugguccggcccguuauagaaaccggccgauacaugagaaaaacugcuugggacaagaaaaagcauuucgccacagugcgcaaggugcugagcuauccacagaacaauaucgucaaaaagaccgagauucagacagguggguuuucuaaagaauccauccuugcacacggcaacucagacaagcugauuccuaggaaaacuaaggauaucuacuuggaccccaagaaauauggaggcuucgauaguccaauaguagcguacagcgugcucguuguggccgacauuaagaaagggaaggcucagaaacugaagaccgucacggagcuacugggaaucaccaucauggaacguucgcgguuugagaagaaucccuccgccuuccuugagucuaaagguuaccucaacauuagagaugacaagcugaugauauugccuaaauauagccuguuugaauuagagaauggcaggcgccgacuccuggcaucagcuggggaacuucaaaagggaaacgagcuggccuugccaacacaguucaugaaauuucucuaccuggcaaguagauauaaugaguccaagggcaagccggaagagaucgagaaaaagcaggaguucgugaaccagcauguuucuuacuuugaugacauucuacaacugaucaaugauuucagcaaacgggugauucuugccgacgcuaaccucgaaaagaucaauaaacuguaucaggauaacaaggagaacauacccguagacgaguuggcgaauaacaucauuaauuuauuuacuuucaccucccugggugccccugcagcuuuuaaauucuucgauaagaucgucgacaggaagcgcuacacaucaacuaaagaagugcucaacagcacccugauucaccagaguaucacggggcuuuaugagacacguauagaccugggcaaguugggagaagauuga

SEQ ID NO: 3190 - RNA, 4134 nt, Artificial Sequence
  Cas9 variant
auggagaagaccuacagcaucggccuggacauugggacaaacuccgugggaugggccgucauaacugaugacuauaaaguucccgcuaagaaaaugaaggugcucgguaauacggauaaaaaguacaucaagaaaaaccuucugggcgcauuguuauucgacucuggggaaaccgccgaggcgacaagacugaagagggcugcccggcgccgauauacucguaggaaaaauaggcuacgguaccuccaggaaauuuuugcaaaggagauggccaaaguagaugaaucauucuuucaacgccuggaggagaguuuccuuaccgacgaugacaagacauuugauagccacccuaucuucggaaacaaggcugaagaggacaccuaucaucaggaauuuccaacuauuuaccaccugagaaaacauuuggcagauuccccggagaagguggaccucaggcuggucuaucuggcccucgcucacaugaucaaauuccggggccacuuuuuaauagagggucagcugaaugccgaaaacacagaugugcagaagaucuucgcggacuuuguugggguguacgaccgcaccuucgaugacucucaccuuucggagauuacggucgaugcagccucaaucuugacugaaaagauuagcaagagucgaagacuggagaaucuaaucaaacaauaccccaccgaaaagaagaacacacucuuuggaaaucugguggcucuugcccugggcuugcagccuaacuucaaaacuaauuucaagcucuccgaggacgcaaaacugcaguuuucuaaggauaccuaugacgaggauuuagaggagcugcucggcaaaauaggggacgauuacgcugaccuuuucacagccgcgaagaaccuguaugaugccauuuugcuaagcggaauccugaccguagacgacaauuccacgaaggcaccacucucagcuaguaugauuaaaagguacgaggagcaccaugaagaucuggagaaacuuaaaacuuuuaucaagguuaacaauuucgacaaauaucacgagaucuuuaaggauaagagcaaaaacgguuacgccggcuauauugaaaacggggugaagcaggacauauucuacaaacaucugaagucuaucauuuccgagaaaaauggaggccaauacuuuuuggauaagaucgaacgggaggacuuccuccguaagcagcgcacauuugauaacgguucaauacccuaucagauucaucugcaggaaaugagaaccaucuuaaggcggcaaggggaguacuauccuuuccugaaagagaaucaggcuaagaucgagaaaauucuaacuuuucgaaucccauacuaugucggaccccucgcccgcaagaacagcagauucgcaugggccaaauaccacagugacgaaccuauuacaccauggaauuuugaugaagugguggacaaggagaaaucugcugagaaguucauaaccaggaugacgcugaacgaucuuuauuugccggaagagaagguccugcccaaacauuccuacguuuacgaaaccuucgcgguguauaaugagcucacaaagaucaaauacguaaacgaacagggcaagagcuuuuucuuugacgcaaauaugaaacaagagauuuucgaucacguguuuaaggagaaccggaaggucacuaaagccaagcugcuuucguaucugaauaacgaguucgaagaauuucgcaucaaugacuugaucggccucgacaaagauucuaaguccuucaacgcuucacuggggaccuaccaugaccugaaaaagauuuuagauaagaguuuucuagacgauaaaacaaaugagcagauaaucgaagacauugugcucacucugacccuuuucgaggauagagacaugauccacgagagguugcagaaguauagcgauauuuuuacaucccagcaacugaaaaagcucgaacgucggcauuacaccggauggggucgacugucuuauaaauuaaucaacggcauaagaaacaaggagaauaacaagacuauccuggacuuccuuauugaugacggggaugccaauaggaacuuuaugcaguugaucaaugacgacagccucucauucaaaacgacaauucaggaagcacagguugugggagaugucgacgauaucgaggccgugguacacgaccugccuggcaguccagcuauaaagaaagguauucuacaauccguuaagaucguggaugaacuggucaaagugauggggcacaacccccagaauauugucaucgagauggcccgcgagaaccagauaaccggcuacggacggaauagaagcaaccagaggcucaagcgccugcaagacucucuuaaagaguucggcucagauaucuugaguaagaagaaaccuagcuacguggacuccaagguugaaaauucucaucugcagaacgaucgauuauuucucuauuacauucagaaugggaaagacauguauacuggagaggaacuggauaucgaccaccuuucggacuacgauauugaccauaucauaccacaggcauucauuaaggauaacagcaucgacaaucgggugcugaccuccucagcgaaaaaccgugguaagagugaugacguacccucuaucgaaauugucagaaacagaaagagcuauugguacaaauuguauaaguccggccucaucucaaaacgcaaguuugauaaucugacaaaagcugaaagagggggacuaaccgagacugacaaggccggcuucauuaagcggcaacugguggaaacaaggcagauaacgaaacacguugcacagauccucgaugcccgauuuaacaccaagugcgacgagaaugauaaagugauucgcgacgucaaggugaucacucugaaaagcucucuuguaucccaauuccggaaggaauuuaaguucuacaaagugagagagauuaacgauuaccaccaugcucacgacgccuauuugaaugcaguugucgguacagcucuguuaaagaaauacccgaagcucgccccugaguuuguguauggggaauacaaaaaguaugacgugaggaagcuggucgcgaaaaguagcgauaaccauucugagcuuggcaaggccaccgcuaaauacuucuuuuauuccaaucugaugaacuucuucaagacagaaguuaaauacgcagacggacguguguuugagcgccccgauaucgaaacuaaugccgacggcgaggugguauggaacaagcagcgggauuucaauauagucagaaaagugcuaucauacccacagguuaacaucgugaagaaggucgaggugcagaccgggggauuuaguaaagaaagcauucucccuaagggugacucggauaaacugauccccaggaagacgaaaaaguugcaaugggagacccagaaguauggcggguucgacuccccaacaguugcuuacucugugcugguagucgccgauguggaaaaaggaaagacucgaaaauuaaagaccgugaaagagcucgucggcauuagcaucauggaacggucaaguuuugaggagaaucccguuuccuuccuggaaaagaaggguuaucacaacgugcaggaggacaaacuuauaaagcugccuaaauacucuuuguuugaguucgaagggggccgcagaaggcuccuggcaagcgcgacagaacuacagaagggaaaugaaguagugcugccacaauauauggucaaccuucucuaccauucccagcacgugaacaauucacacaaaccggagcaucugaacuauguuaagcagcacaaggaugaauuuaaagacauuuucaauuugaucaucagcauugcccggauaaacauccugaagcccaaaguggucgauaauuuaauuaacgaguuuacugaauacggccaggaggacaucaguucucucuccgagagcuucauuaaucugcuuaaguuuaucucguucggggcuccuggagccuucaaauuucugaaguuggacgugaaacaaucaaaccuccgauacaagucuaccacggaagcacugagugcuacacuaauacaucaguccguuaccggccuguaugagacuagaaucgaucuuagcaagcucggugaagaguga

SEQ ID NO: 3191 - RNA, 4137 nt, Artificial Sequence
  Cas9 variant
augaagaccuucgccgaggaauacgugauggacaaaagcaagcccuauggcaucgggcuggauauuggaacaaacuccgucgguuuuguugcuacugacgcagagggccaccucauaagacuuaaagggaagacggugaucggagccuaccuguucaaugcgggcauuucugcugccgaaaggcgggguuuucgcaccacacgacguagauugucaaggguaaaauggcgguuagggcugcuacgcgagaucuucgaaacucauuuucaggagaguaugggagagaacgaagauaaugacuucuuucucagauucaaguauagcaacauuuccccuaaggauccacaauuuucuaccgcaaaaggccuguucaaugacaggacagauaaggaguuuuacgaccaguauccgaccaucuaccaccuucggcgcgcccugaugacugaagaucaucaguucgacauacgagagaucuauauugcuaugcaccauaucgugaaauacagaggccacuuuuugaaggaggggagggcaaaagauuucaaggucggagaccuccggcugcuggauaacuucaagaugaugaaugaacagauugaggaaaucaacccccucuggcaauuaaaacugccuacagacgacgccucgauaaagucaauuaccgcuauccuuuuggauaauacgcagagccagaacgaccgucagaaagccgugacuaagguuauucuggcgacccuagugaaagcaagugauaaggacaucaaugccgcucgcaaaagauuugucggugagcucuccaaggccauggugggccugaagacaaaacuuuggguacuggcagauguuucucaaaacggggacugggaaaucaaguacgagaauuaugcugauuucgccgagacuauuggaagcggcgaauccgacaccauacagucauuguuuaacgagaucaaugaucucuacggugugauuacacuggcggggaucauaccaaaagaagccgagaguuucagcgacggaauggucaggaaguaugaacaccaucggaaaaacuuagagcugcucaagguguacugcgcagagcagucugauggcaagcgaggccgccagauuagacaaaccuaugacaaauacaucgacgggguggauuccaagcaguuuacgcaggaagacuucuauaaagcucuuucaaaguuuacugccaaagaugaggcuacaagcgaaaacgccaagcugaucgcacaagagauugccgucggaaccuucaugcccaaguugaggacuaaagcuaaugguacaaucccucaccagcuacaucagaaggaacuggacgcgauuauagagaaccagaaaaaguacuacccauggcucggcgagguuaaucccguggaaagucaccggcgcgcacugccuuauaaacuugaugagcugguaucuuuuagaaucccauacuauguggggccgauggucacccccacgaagggagacccugaaaaguccaaauucgccuggauggugaggaaggagccaggcaccauuacacccuggaacuuugaucaaaaaguugaccguagcgcuucgggugaggccuucauccagcggaugaagacuaccgauacauuuuugaucggggaagacgugcucccucagcagucucuguuauaccaaaaauucgagguccugaaugaacuaaacaagauuaugauaaauggcaaaccaaucugucgagagcagaagcagagacucuucaagcagcuguuuaugcaauauaaaacugugaccguaaagaaaguucagcagaaccuuauugcaaauggagaagaguccgagaacgugcccaucacaggcuugucagauccgcugagguucaauaguagcuuuuccaccuacauugacuauaaggauauccucgggacugccgcugucaacgacaaugccaaacagucugacauagaacaaaucauugcauggagcacgaucuucgaggaugcggcuauuuuucgcgaaaagcugaacgacaucacauggcuuaaugaugaccagcggaacaagcugucacacaaaagauacaggggauggggucgccauagucgaaaguugcucgccggccugcgggauggggagggacagaccauaauugaacguuuauggaacacuaaugacaacuucaugcaaauccagaaugauuccgagauugcaagacagaucaccgaggccaacagcucuaaaauggcuacagccgaaggcaccgacgagauaaucgaugguuuuuacacuucaccugaaaauaagaaagcacugagggaggugaugaaggucgugaaggacauucagcgcgcucaccaugggcaagcccccgcguggguuuauaucgaaaguccacgggagacaccuagacccggccagaggacggugagccgagagcagcagcuaaccgaucucuacgaaggagccgcuaaagagauuguagacgaugcaguccugaacgaacuuaaggacaaagugaaguccaaagagaauuucacugacaaguugguucuguauuuucuccaaaacggccacgauaucuacgccaaugacucuauaaacauugauaaucugaacgcuuaugacaucgaucauguguuaccacagucgcugaucaaggacgauagccuugacaaucgcgucuugacaacccacgagcggaaccucaaaaaguccaauagauucgccacagaacuguuugcagaucagaggaaaaagugggagaaauggcaccgucuagggcugauuucaagucgcaagcucaaacaucugacuaugcagcccaacucuguggaaaaguucgcgcacggauuuaucgcccggcaacuuaccgagacgagacagauuauacauuugaccgcuaacguacugagcaauuuauaccaggaaaacgacacaaagaucgugaugauuaaagccggucucaauuccgaguucaggcgaacuuucgauuuuccuaagaaccggucaguuaaugacuaucaccacgcauucgacgcuuuucugaccgccaaaaucggccgcuaccuucuggcaagauacccaaaguuggagccguucuuugucuaugggaacuucgugaaaaaucccaaggccaugaagaggcucagcucuuuugauuucauugcucaacuggcggccaaaacagacgauacuucccauaucgaccagcggagucuaaaacaggugccugucguuaacgaagagaccggagaaauagugugggauaaggacaucgagcuggcagaacucgauaagacguacaauuauaaaacaaugcuggugaagcgagcucagaccgagaacaaugcccaaauguuuaagcagacuguauucaaagccagagacaaccagaauaagacacuuauuccagucaaaaacggcuugagcaccgauguguacggugggcacucucagcaagcuaucuccuaucugugcauuguuugggugggccagaagaaaaaguaccgcgucuuaggaaucucaacugcacaugccggcauacucaauaacuuugagaagaacuaugggagguucgaagcgaaaaagaaacugcaggagauugugaguaauacccuugacaacgcugaucguaaugacuucaagaucguugcccccaaagugcuguuugaacagguagucgaggaugacaacaugaaguucggacuaggcagcgcaucggacuaccggaaugugcaacagcucuuucuguccagaaagaaccaguugcuguuagccaauaugaugacagaucagauccacgaccaagaucucgugcaucuguucgacgaaauugucggucagaugaacgcucacuuuccuauauucgaucgcgggggauacaggucuagccuuacgcagucacgagacaaauuucugaaguugccauucaaaaagaaugaggaucucaucaccaaacaagagguuauuagacggauccuggacggccuacacgcaaacgccaauaggaaggaucugaaaauuaucgguaguaagggcgacuuugggcgccuuggaacuaagaaaauauaucucuccaaggaugcgaaacugaucuacacaucucccaccuguuuguucacacguacugugccgcugagcuccuuauga

SEQ ID NO: 3192 - RNA, 4137 nt, Artificial Sequence
  Cas9 variant
augaccaacgagaaguacagcaucggccuggacauugggacauccucuauaggauucgccguggucaaugauaacaauagaguuaucagggugaaagguaagaacgcuauuggcguacggcucuuugacgaagggaaagcagccgcggaucgccgaucauuccguacuacgagaaggcggcuuagucgcagaagguggcggcugaaguuguuacgcgagaucuuugacgcuuauauuacccccguggaugaagccuucuuuauccgacugaaagagagcaaucuauccccuaaggacucuaagaaacaguacucgggagauauacucuucaacgacagaucagauaaggacuuuuaugaaaaauacccaacaaucuaucaccugaggaaugcacuuaugacugagcaucggaaguucgauguccgugagauuuaccuggccauccaccauauuaugaaauuucgcggccacuucuugaacgcuaccccggcaaauaacuuuaagguggguagacucaaucuggaagagaaguucgaagaacugaacgacaucuaucaaaggguuuuucccgaugagagcauagaguuccggacagacaaucucgagcagauuaaagaaguguuacuggacaacaagcgaagucgcgccgauagacagaggacccuugucuccgacaucuaccagucuagcgaggauaaagacauugaaaagcggaauaaagcuguggccacugagaucuugaaggcgucccuggggaacaaagcaaagcuaaacguaaucacaaauguugagguggauaaggaagccgcuaaagaguggucaauuaccuucgacagugaaagcauagaugacgaucucgccaagaucgagggacaaaugacggacgauggccaugaaauuaucgagguccugcgcucucuuuacuccggcauaacucugucagcaauugugccugagaaccacaccuugagccagaguaugguggcuaaauaugaccuccacaaggaccaucugaaauuauuuaagaagcugaucaaugggaugacagauacuaaaaaggccaaaaaccucagagcggccuacgacggauauaucgauggugucaagggcaaaguucuuccacaggaagacuucuacaaacaggugcaaguaaaucuggaugacucugcagaggcuaacgaaauucagaccuauaucgaucaggacauuuuuaugcccaagcagaggacaaaagccaauggguccauaccucaccaauugcagcagcaagagcuagaucagaucauugaaaaccagaaggcuuacuauccauggcuggccgagcucaaucccaacccugacaaaaagcgucagcaacuggcaaaauacaaacuugaugagcuggugaccuuccgggucccauacuaugugggaccgaugaucacggccaaggaccagaaaaaucagagcggcgcugaauuugcguggaugauccgaaaggagcccgguaacauuacuccuuggaauuucgaucagaaaguugacagaauggcaacagccaaccaauuuauaaagaggaugaccacuacagacaccuacuugcucggggaagaugugcugccagcucagucguuacuguaucagaaauucgagguccuaaaugagcucaacaagauccgcauugaccauaaacccaucucuauugaacagaagcaacagaucuuuaacgaucuguucaagcaguuuaaaaaugugacgauaaagcaccuucaggacuacuugguaucccaaggacaguauucaaaacggccucugaucgagggccucgccgaugaaaagagauucaacaguagccuguccaccuacucugaccuuugcggcauuuuuggggcaaaacugguugaggaaaaugauaggcaggaggacuuggagaagaucauugaauggagcacaaucuucgaggauaagaaaauauaucgcgccaagcucaacgaccugacuugguuaaccgaugaccaaaaagaaaagcuggcuacaaaacgauaccagggauggggucggcuaucacguaagcuccuggugggccuuaagaauagugagcacagaaacauuauggauaucuuguggauuacuaaugaaaacuucaugcagauccaggccgagccagacuuugcaaaacuggucaccgacgcgaauaaggggaugcucgagaaaacagauucccaagacgugauaaacgaucuguacaccagcccccagaauaagaaagcuaucaggcagauuuuacuggucgugcaugacauccagaacgccaugcacggacaagcaccggccaagauucauguugaguucgcucgcggcgaagaacggaauccuagaaggucugugcagcgacagcgccagguagaggccgcauaugaaaaggucucaaacgagcuugugagugcuaaaguucggcaagaguuuaaggaagccaucaauaacaaaagagauuucaaggacagguugcuccuguacuuuaugcagggugggauagauauuuauacuggcaaacagcuaaacaucgaccaacugagcuccuaccagaucgaucacauucucccccaggcguucgugaaggacgauucucugacgaaucguguccuuacaaacgagaaucaggugaaagccgacucgguaccaaucgacauuuuuggaaagaagauguugagcguguggggccgcaugaaagaucaagggcugauauccaagggaaaauaucggaacuuaaccaugaauccugaaaacaucucagcucauacugagaaugguuucauuaacagacagcucguugagaccaggcaggucaucaagcuggcagugaauauucuugccgacgaauacggcgauaguacacagaucauaucugugaaagcugaccugagccaccaaaugcgagaggauuuugaauugcucaagaaccgggacgucaaugauuaucaccaugccuucgacgcauaccuggcggccuuuaucgggaacuaccuacugaagcgcuaucccaaacucgaguccuacuucguuuauggagauuuuaagaaauucacccagaaggaaacuaaaaugagaagguucaauuuuauuuacgaccugaagcacugugaucagguggugaacaaggagacaggcgagauccuuuggacgaaagacgaagauauuaaguauauccggcauuuguucgcuuacaaaaagauacugguaucacacgagguccgagaaaagagaggugccuuauauaaucagaccauuuacaaggcaaaggacgacaaagggagcggccaaggaucuaagaaacucauccgcaucaaggaugacaaagagacuaagauuuacggcggguauuccggaaagagucuggcuuacaugacaauagugcagaucaccaaaaagaacaaaguuagcuauagggugauugguaucccaacacuugcccuggcacgucuaaacaagcucgaaaaugauucuacugagaacaauggcgagcuguacaaaauuaucaagccccaguuuacccacuauaaagucgacaagaagaacggggaaauaaucgagacgaccgaugacuucaaaauugugguuuccaaggugcgguuucagcaauugaucgaugacgccggacaguucuuuaugcuggcuucagauacauacaaaaauaacgcgcagcaauuaguaauuaguaauaacgcccucaaggcaaucaauaacacuaauauaaccgacugcccuagagaugaccuggaaaggcuugauaaccugcgcuuggacagcgcuuucgacgagauugucaaaaagauggauaaguauuuuucggccuacgacgccaauaacuuccgagaaaagaucagaaauuccaaccucaucuuuuaccagcugccaguggaggaucagugggagaauaacaagauuacagaacuaggcaaacggacugugcugaccaggauccuucagggucuccaugcuaacgcaacgacaaccgacaugucuauauucaagauuaaaacuccguucgggcaacugcgccagcguagcggcaucucauugagugagaaugcccagcugauuuaucagucccccacaggauuauuugaaagacggguccaacucaacaagaucaaguga

SEQ ID NO: 3193 - RNA, 4137 nt, Artificial Sequence
  Cas9 variant
augaagaacaaagacuacagcaucggccuggauauugggaccuccucuauaggauucgccguggucgacgagaauaaccacguuaugagagugaaggguaaaaaugcuaucggcguaaggcucuuugaugaagggaagcccgcagccgaccggcgcgcguuccgaacaacucguagaaggcuuucacggcgcagauggaggcugaaauuguuacgggagauuuuugauaguuauaucacgccuguggacgaggcuuucuuuauucgccugaaggaaagcaaccuauccccaaaggauucuaaaaagcaguacucgggagacauccucuucaaugaucgaucagacaaagauuuuuauaccaaguacccgacaauauaucaucugagaaacgcccuuaugacugaacaccaaagguucgacauccgggagauuuaccuggcaauccaucacauugucaaauuucguggccauuucuugaaugccacccccgcuaacaauuuucagguggguaagcucgaucuggaccagaaguucgaggaccugaacgauaucuaucagcgcguuuuuccugacgauagcauagaguucagaauugacaaucucgaacaaaucaaagcaguguuacuggauaguaagaggucccggucugaccgacagcgcagccuugucgaugacguguaccagacauccgaagauaaagagguagagaagcagaacaaagccguugcuaccgaaguguugaaggccauucuggggaauaaagcgaagcuaaacaucaucgcaaaugucgagguggacaaggaagccgcuaaagaguggacuauuacauucgauucagaaaguauagacgacgaucucgccaagaucgacggacaaaugaccgaugacggcagagcaauuguggagauccugaggagccuuuacucuggcauaacgcuguccgcuauugucccagagaaccacacuuugucacaggccaugguugcgaaauaugaucuccacaagaaacaucugaccuuacugaagaagcucaucaacagcaugacagacacuaaaaaggccaaaaaucuucgggcagcuuacgauggguauguggacggaguaaaggguaaagugcugacccaggaugaauuuuacaagcagauccaaaguaacuuggacgagucugucgaagccuccgagauucagacauauaucgaucaggacauuuucaugcccaagcaacgcaccaaagcuaauggcagcauaccucaccagcuacagcagcaagaacuggaucagaucauugagaaccagaaggaguacuauccauggcucgccgaacugaaucccaacccugacaaaaagagacagcaacuugcaaaauacaagcuggacgaguuggugacguuuaggguuccauacuauguggggccgaugaucacugccgaagcucagaagaaacagucgggagcggaguucgcauggaugauccguaaggaaucuggcaauauuacacccuggaacuuugaucagaaagucgaccggauggccaccgcuaaucaauucauaaagcgaaugacuacaaccgauacguaccuccugggugaggacguguuaccuucccagucacugcuauaucagagauuugagguacucaacgaacugaauaaaaucaggauugaucgcaagccaaucaguguugagcuuaaacagcaaauuuucaacgacuuguuuaagaaguucaaaaaugugaccaucaagcaucugcaggauuaccucgucgcccaggggcaauauagcaaacggccccugauagaaggacuugcagacgagaagagauuuaacuccggccugucuacauacaaugauuucugcggcaucuuuggggccaaauugguggacgagaacgauaggcaggcugaccucgaaaagauuaucgaguggagcacuauuuucgaagauaagaaaaucuaucgcgccaagcugaacgacuuagcauggcugaccgacgagcagaaagauaagcuagcgacaaaacgauaccagggauggggucggcucucaaguaagcugcuuauaggcuugcaaaauuccgaacaccguaacauuauggaccugcucuggaucgggaaugagaacuucaugcagauucaggcugauagcgacuuugccaagcugaucaaagaugcaaaucagaacgccuuacaaaauaacgacucucaggaugucauaaaugaccuguacacuucaccucagaacaagaaagcuaucagacagauucuuuuggugguucacgauauccaaaaugccaugcauggacaggcaccaaccaagauucacguggaguucgcuaaaggcgaagagaggaacccccgccggaguguacagagacaaaggcaggucgaagccgcguaugagaaggccagcaaugaacucgugggugcuaacguucgagaggagcugaaggacgcaaucacaaauaaacgcgauuuuaaggaccggcuauuccuguacuuuaugcaagggggcguggacauguauuccggagaaccgauaaacauugauaaccucucuagauacgacaucgaucauauccugccucaggccuucgucaaagacgauucgcuuaauaacaggguguugaccgacgcugagaagaaucgucgcaaaagcgaugccguacccaacgaacuguuuggcgcaaagaugcgggugacuugggagagaaugaaagaacagggguuaauuuccaagggaaaguauaggaaucucacgaugaacccagagaauaucaacaaauacacagagaaugguuucauuaaccgacagcugguugaaacccggcaggucauaaaacuugcggugaauauccuggccgacgaguauaaggaaaacacucagauuaucucagugaaggcugauuugagucaccaaaugcgcgaggacuuugagcuccugaaaaauagagaugucaacgacuaccaucacgccuucgaugcauaccuagcugccuuuaugggcaauuaucugcucaagagguacccuaagcugcggucuuauuucguuuacggggacuuuaaaaaguucacccagaaagaaauuaaacuucgaagauucaacuuuaucuaugacuugaagcacgaggaucaggugauagacaaggaaacaggagagauccuguggaacaagaaugaagauauugcauacauccgccauuuauucgccuauaaaaagauucucaucagccacgagguguccgagaggcguggcgcucuguacaaccagaccguauacaaagcgucagacgauaaggccagcggucaagggucuaaaaagcugauacccauuaaguccgacaaaccaacugaaaucuauggcggauacacaggccggacgcuugcauauaugaccaucgucaaggugacuaaagggaagaaaauuaguuacaagguugugggaguccccacagcugugcuagccaagauggccgguguuagacagggcagccaggaggaacaggauaaacucuauggggugcugaagccucaauuuacccaucagaaagagaauaagaaaacaggagaaauaacugagaccguagacaaguucgauaucauugucccaaaagugaaguaccagcaauuggugaacgacaauggccagcuguuuaugaucgguucugauacguuaccguauaacgcugagcagcucguccuguccaaggaaucaguucagaccauuaauaaccccgggaucaaagacgagggcagugaugaagagagcgaaaauaagaaacuugacaacguguacgacgagauaguacuguguaugaauaaguacuucccuuuguaugauaacaggggauuucgcaauucgaucacaaacggcaaaaauaaguuccucaagcugccaauuaaaaacaucuacaagaaugggaaacuaauuaacgugggaaagcgagaggucaucaacagaauacugcaaggccuucacgcaaaugccuccgugacugaccucucuaaccuggguauuaaaagccccuuuggguucuugcagaagggagcgggccugucauuaaguggugaagcucagcucauccaccaguccgccaccggccuguuugagcaucggguucaacuuaauaagaucaaauga

SEQ ID NO: 3194 - RNA, 4137 nt, Artificial Sequence
  Cas9 variant
augagcaacaagcccuacuccaucggccuggacauugggaccaauucugugggaugggccgucauaacagaugacuauaaaguuccuucaaagaaaaugaaggugcucgguaacacugauaaacacuucaucaagaagaaucuuauuggcgcucuguuguuugacgaggggacgaccgcagaaggaagaagguuaaaacggacagcccgccgacguuacacuagaaggaagaaccggcugcgcuaucuacaggagaucuucagugaagagauuagcaaaguagauuccucguuuuuccauagacucgacgauucuuuucuggugccagaagacaagaggggcucaaaauacccgaucuucgcgacccuugcugaggagaaggaauaucacaagaauuuucccacaauauaccaucugcggaaacaauuggccgauagcaaggagaaagcagaccuccgccugaucuaucuggcccucgcucacaugaugaaguaccgaggucauuucuuauacgaagagaguuuugauauuaaaaacaaugacauccagaagauuuucaacgaguuuaucuccauauaugauaauaccuucgaagggucuagccuguccgagcagaacguccagguggaagcaauuuuuacugacaaaaucucaaagagugccaagagagagaggguucuuaaauuguucccugacgaaaagagcacaggacuguucucugaguuucuaaaacucauugugggcaaucaagcugaguucaagaaacacuuugaucuggaagagaaggccccacuucaguucuccaaggacaccuacgaugaagaccuggagaacuugcucggccagaucggggauggauuugcggaccuguucuuagucgccaaaaagcuguaugaugcaauccuccuuucagguauucugacggugacugaccccagcaccaaagcuccuuugagugccucuaugauagaacgguacgagaaucaccagaaggaucuagcaucccugaaacaauuuaucaagaacaaucucccagcugagaagugcguagaaguuuucagcgaccagucgaaagauggcuaugccggguacauugacggaaagacaacucaggaggcguuuuauaaauacaucaagaaccugcuuucuaaacuggaaggcgccuacuauuucuuggacaagauagagcgugaagauuuucuccgcaagcagagaaccuucgacaacgguuccauuccccaucaaauccaucugcaggagaugaaugcaaucuuaaggcggcagggggagcacuacccuuuucugaaagaaaaccgagagaagauugagaaaauccuaacauuccgcauuccauaucacgugggaccgcucgcuagaggcaauagggauuucgccuggcugacccggaacucagacgaagcuauacgccccuggaauuuugaggaaaucgucgaucaagccaguagcgcagaggacuucauuaacaagaugacgaauuacgaucuuuauuugccugaagagaaagugcugccaaagcacucccuccuguacgaaacuuuugccguguauaacgagcuuacaaaagucaaguucaucgcugagggccugaccagauaccaguuuuuggacaagaaacagaagaaagauaucuucuacacauuuuucaaggcggaagacaaaaggaagguuacugagaaggauauuauacauuaucuccacaauguggacggguacgauggaaucgaacugaaagguauugagaagcaguuuaacgcaucuuuaagcaccuaucaugaccugcuaaaaaucauuaaggacaaagaguucauggaugaccccaagaaugaagagauccucgaaaacauaguacacacgcugaccaucuuugaggaucgugaaaugauuaagcaacggcuugcccaguacgacucauuguucgaugagaaagugaucaaggcucugacacgaagacauuauacuggcugggggaaacucagugccaagcugauuaauggaaucugugacaaacagaccggcaagacaauauuagauuaccugauugacgaugguaagaucaacaggaauuuuaugcagcuuauuaacgacgauggguuguccuucaaagaaaucauacaaaaggcacaggucgugggcaaaacuuaugacguuaaacaggugguccaggagcucccuggaagcccagccaucaaaaagggcauucugcaaucugugaagcuaguagaugagcugguuaaggugauggggcacgcucccgaaucaaucgucauugagauggcccgcgaaaaccagaccacagcaaaggguaaaaagaauagucagcagcgguacaaaagaaucgaggacgcgauaaagaaccucgcuccgggacuggacagcaccauucuuaaagagcacccuacugauaauauccaauugcagaacgacaggcuguucuuauacuaucuccagaauggccgcgauauguacacggggaagccccuggaaaucaaccaacuuuccaauuaugacauugaucauaucauuccacaggccuuuauaaaggacgauucucuggacaaccgaguguugacaucgagcaaagagaaucggggaaaguccgauaacgucccuucacucgaagugguugagaaaaugaaggcauucuggcagcagcugcuagacaguaaacugaucucugaacguaaguuuaauaaccucaccaaggccgagagaggcggucuggaugagcuugacaaagugggguucauuaagaggcaauugguagaaacucgccagaucaccaaacacgucgcucagauucuggacgcccgguuuaauaaggaggugacagagaaaaacaagaagaauagaaacguuaaaaucauaaccuuaaagagcaacaugguguccaauuucaggaaagaauuuggccucuacaagguccgagaaaucaacgauuaucaucacgcacacgacgcuuaccugaaugccgugguagcgaaagccauucuuaagaaguaucccaaacuggagccagaguucguguacggagauuaccagaaguaugaccuaaaacgcuacaucucaaagagcaaagaucccaaggaaguugagaaagcuacugaaaaguacuuuuucuauucuaaccuccugaacuuuuucaaggaggaaguccauuaugcagacggcacaauugugaaacgggagaauaucgaguacuccaaggauacgggggaaauagccuggaauaaagagaaggacuucgcuaccauuaaaaagguguugaguuuuccucaagucaacaucguuaagaaaacugaggaacagacagugggacagaaugguggccuguucgauaacaauaucgugagcaaggagaaaguagucgacgccucuaaguuaauuccaauaaaauccgggcucucaccggaaaaguauggaggcuacgcaagacccaccaucgcguacagugugcugguuacauauaagcagaacaauaaaauuaagaacacuaugguggguaucccuguccuuaccaaacuggaguuugaaagggauccaaauuuguaccuccguaaccuggggauuaacaaugugagccacguuaucaagcuagugaaacauacgguacuggaguucaagcacaaguauggcaccuaccgccgguuuauagucucgaaccaagaacuuaaaagagccaaucagaucuucgugacaacuaagcagaugaaacucauuucccaauauaccacacuggacaagaacgagcaugauucuuugcugaaaaauaaccagcaguuaauccagagcauuuggaaucaauuucucgaguucaugcuggcuacugaccuugugaacaagaaacaguacgacgaacugaucuugaccaauaaccagacgauagaggaaugcaggaauauuaugaaccgagucaucacaacccucucauuuacuaauaucaacgccggacagaagaagauuaucuucgaugacacacugagucuacccauaaaacgguggcaauuuaccgauuccgacaagaugguuaaaaagauuaucgagucuacucugauucaccagagcaucaccggccuuuaugaaacacgcauagaucucaauaaacugggggaggacuga

SEQ ID NO: 3195 - RNA, 4137 nt, Artificial Sequence
  Cas9 variant
augaacaagcccuacagcaucggccuggacauugggaccaauuccgugggauggucuauaaucacagaugacuauaaagucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauaggauucuguaccuacaggaaaucuuugcugaggaaaugucaaaaguggacgauaguuucuuucacagacucgaggacagcuuccugguagaagaggauaagcggggcuccaaauauccaauauuugccacuaugcaagaggaaaaguacuaucaugagaaauucccgaccaucuaccaccuucgcaaggaacuggcagacaagaaagagaaggccgauuugcgacucauuuaccuggcucuggcacauaucauuaaauuuagaggucacuuccucaucgaggacgauagguuugacgugcggaacacagacauacagaagcaguaucaggccuucuuagaaauuuuugauaccacuuucgagaauaacgaccugcuuucucaaaaugucgauguggaagcuaucuugacagacaaaauuucgaagucagccaaaaaggaucguauccuggcgcgcuaccccaaccaaaagagcaccgggaucuuugcagaguuccuaaaacucauuguuggaaaucaggccgacuucaagaaacauuuuaaccuggaagauaagacgccucuucaguucgcuaaagacaguuaugaugaggaccuggagaauuugcucggccagauaggcgaugaauuugccgaccuguucuccgcagcuaagaaguuauacgacucugugcugcucagcgggauccuuacugucauugaucuguccaccaaagccccauugucagcgaguaugauccagagauaugacgagcaccacgaagaucuaaagcaucugaaacaguuugugaaggccagccuccccgagaacuacagggaaguauucgcagacucuuccaaagauggauaugcugguuacauagagggcaagacaucacaggaggccuuuuacaaguaucugcuuaaacuguugacuaagcaagaagggagcgaguaccuccuggaaaagauuaagaaugaggacuucuuacggaaacagcgaaccuuugauaacggaaguaucccucaccagguucaucugacagaacuacgcgcuaucauuagaaggcaaucugaguauuacccauuccucaaggagaaccuggaccggaucgaaaagauucuuaccuuucgcauacccuauuacgugggcccuuuggccagagagaaauccgauuucgcauggaugacgaggaagacugacgauagcauccguccauggaauuuugaagaccuggucgauaaagagaagucggccgaggcuuucauucaccggaugacaaacaaugaccucuaucugccggaagagaaagugcuucccaagcacucucugaucuacgaaaaauucaccguguacaacgaguugacuaagguccgauuucucgcggaagguuucaaggacuuucaguuccugaauagaaaacagaaggagacaaucuuuaacuccuuauucaaagagaagaggaaaguuaccgaaaaggauauuauaucauuucugaauaagguggacggguaugagggaaucgcaauuaaaggcaucgaaaagcaguucaacgccagucuaagcacguaccaugaucucaaaaagauucugggcaaagacuuucuugauaauaccgacaacgaguugauccuggaagauauaauccaaacacucacucuguucgaggaccgcgagaugauuaagaagcgguuagauaucuauaaagacuuuuucaccgaaucccagcugaagaaacuuuacagaaggcacuauacaggguggggacgcuugucugcuaagcucauuaaugguauccgaaacaaagagaaucagaagacuauacuggauuaccuaauugacgauggcagcgccaaccggaauuuuaugcagcugaucaaggacgcagggcucucauucaaaccuauuaucgacaaggcccguaccggaagucauuccgauaaccugaaagaaguagugggcgagcuugcugguagcccagccauaaagaaagggaucuugcaaucucugaagauugucgacgaauuagugaaaguuaugggcuaugagcccgagcagaucguggucgaaauggcaagagagaaccagacaaccgcgaagggacucucaaggagucgccagcggcugacuacgcuuagagaaagccugggcaauuugaaguccaacauucucgaggagaaaaagccuaaauacgugaaggaucaaguagaaaaucaccaucugucugacgauaggcuauuccuguacuaucuccagaacgggaaagacauguacacagaugacgagcuggauaucgacaaucuuucgcaguaugauauagaccacauuaucccacaggcuuuuaucaaggacgauagcauugacaaccgaguuuugguguccucagccaagaaucgcggaaaaagugaugacguccccucuaucgaaauugugaaggcacggaaaauguucuggaagaaccuguuagaugccaaacucaugagccaaagaaaguacgacaaucugaccaaggcugagagggguggccuuacuuccgaugacaaagcccguuuuauacagcgccagcuggucgaaacccggcaaaucacaaagcacguggcaagaauuuuggaugagagguucaacaaugagcucgacucaaaagggcgacggauccgcaagguuaaaauugugacccugaaaagcaacuugguaucuaauuuuagaaaggaguucggauuuuauaaaaucagggaagucaacaauuaccaucacgcucaugaugccuaucugaacgcggugguugccaaggcuauauuaacuaaauacccgcagcucgaaccugaguucguguacggccuguaucggcgaaagaaacuuuccaagaucgucagagaagacaaggaggagaaauacagugaagcaacacgcaagauguuuuucuauagcaaccugaugaauauguuuaaaagggugguacguuuggccgaugguucuauugugguucggcccgucaucgagacggggagauacaugggcaagaccgcuugggacaaaaagaaacacuucgccacugugaggaaggugcucuccuauccacagaacaauauugucaagaaaacagaaauccagaccggaggcuucucaaaggagaguauacuggcacacgggaacagcgacaaacuaauuccucgcaagacaaaagauaucuaccuggaccccaagaaguauggagguuuugauucgccaaucguugcguacuccgugcuugugguagccgacauuaaaaagggcaaagcucaaaagcucaaaacugucaccgaacuguuggggauaacgaucauggagcgaucuagauucgagaagaauaccagcgccuuucuggaaucaaagggauacuuaaacauucgggaugacaaacucaugauccugcccaaguauagucuuuucgagcuggaaaauggcaggcgccguuugcucgcauccgcuggugagcugcagaaagggaacgagcuagcccugccuacacaguuuaugaaguuccuuuaccucgcaucuagauauaaugaaagcaaaggcaagccagaggaaauugagaagaaacaggaauuugugaaccaacauguuuccuacuucgaugacauccugcaguugauaaaugauuuuucaaaccgggugaucuuagccgacgcuaaucuggagaagauuaacaaacucuaucaggauaauaaggagaacaucccggucgacgaacuggcgaacaauauuaucaaccuuuucacuuuuaccagccugggagcccccgcagcuuucaaauuuuucgauaagauaguggacaggaaacgcuacacaaguacuaaggagguucuaaauucuacccuaauucaccaguccaucacgggccuguaugaaacacgaaucgaccucgggaagcugggagagggcuga

SEQ ID NO: 3196 - RNA, 4137 nt, Artificial Sequence
  Cas9 variant
augaccaacgagaaguacagcaucggccuggacauugggacauccucuauaggauucgccguggucaaugauaacaauagaguuaucagggugaaagguaagaacgcuauuggcguacggcucuuugacgaagggaaagcagccgcggaucgccgaucauuccguacuacgagaaggcggcuuagucgcagaagguggcggcugaaguuguuacgcgagaucuuugacgcuuauauuacccccguggaugaagccuucuuuauccgacugaaagagagcaaucuauccccuaaggacucuaagaaacaguacucgggagauauacucuucaacgacagaucagauaaggacuuuuaugaaaaauacccaacaaucuaucaccugaggaaugcacuuaugacugagcaucggaaguucgauguccgugagauuuaccuggccauccaccauauuaugaaauuucgcggccacuucuugaacgcuaccccggcaaauaacuuuaagguggguagacucaaucuggaagagaaguucgaagaacugaacgacaucuaucaaaggguuuuucccgaugagagcauagaguuccggacagacaaucucgagcagauuaaagaaguguuacuggacaacaagcgaagucgcgccgauagacagaggacccuugucuccgacaucuaccagucuagcgaggauaaagacauugaaaagcggaauaaagcuguggccacugagaucuugaaggcgucccuggggaacaaagcaaagcuaaacguaaucacaaauguugagguggauaaggaagccgcuaaagaguggucaauuaccuucgacagugaaagcauagaugacgaucucgccaagaucgagggacaaaugacggacgauggccaugaaauuaucgagguccugcgcucucuuuacuccggcauaacucugucagcaauugugccugagaaccacaccuugagccagaguaugguggcuaaauaugaccuccacaaggaccaucugaaauuauuuaagaagcugaucaaugggaugacagauacuaaaaaggccaaaaaccucagagcggccuacgacggauauaucgauggugucaagggcaaaguucuuccacaggaagacuucuacaaacaggugcaaguaaaucuggaugacucugcagaggcuaacgaaauucagaccuauaucgaucaggacauuuuuaugcccaagcagaggacaaaagccaauggguccauaccucaccaauugcagcagcaagagcuagaucagaucauugaaaaccagaaggcuuacuauccauggcuggccgagcucaaucccaacccugacaaaaagcgucagcaacuggcaaaauacaaacuugaugagcuggugaccuuccgggucccauacuaugugggaccgaugaucacggccaaggaccagaaaaaucagagcggcgcugaauuugcguggaugauccgaaaggagcccgguaacauuacuccuuggaauuucgaucagaaaguugacagaauggcaacagccaaccaauuuauaaagaggaugaccacuacagacaccuacuugcucggggaagaugugcugccagcucagucguuacuguaucagaaauucgagguccuaaaugagcucaacaagauccgcauugaccauaaacccaucucuauugaacagaagcaacagaucuuuaacgaucuguucaagcaguuuaaaaaugugacgauaaagcaccuucaggacuacuugguaucccaaggacaguauucaaaacggccucugaucgagggccucgccgaugaaaagagauucaacaguagccuguccaccuacucugaccuuugcggcauuuuuggggcaaaacugguugaggaaaaugauaggcaggaggacuuggagaagaucauugaauggagcacaaucuucgaggauaagaaaauauaucgcgccaagcucaacgaccugacuugguuaaccgaugaccaaaaagaaaagcuggcuacaaaacgauaccagggauggggucggcuaucacguaagcuccuggugggccuuaagaauagugagcacagaaacauuauggauaucuuguggauuacuaaugaaaacuucaugcagauccaggccgagccagacuuugcaaaacuggucaccgacgcgaauaaggggaugcucgagaaaacagauucccaagacgugauaaacgaucuguacaccagcccccagaauaagaaagcuaucaggcagauuuuacuggucgugcaugacauccagaacgccaugcacggacaagcaccggccaagauucauguugaguucgcucgcggcgaagaacggaauccuagaaggucugugcagcgacagcgccagguagaggccgcauaugaaaaggucucaaacgagcuugugagugcuaaaguucggcaagaguuuaaggaagccaucaauaacaaaagagauuucaaggacagguuguuucucuacuucaugcagggugggauagauauuuauacuggcaaacagcugaacaucgaccaacuaagcuccuaccagaucgaucacauucugccccaggcguuugugaaggacgauucucucacgaaucguguccugacaaacgagaaucaggugaaagccgacucgguaccaaucgacauuuucggaaagaagaugcuuagcguguggggccgcaugaaagaucaaggguugauauccaagggaaaauaucggaaccugaccaugaauccugaaaacaucucagcucauacugagaaugguuuuauuaacagacaguuaguugagaccaggcaggucaucaagcucgcagugaauauucuggccgacgaauacggcgauaguacacagaucauaucugugaaagcugaccuuagccaccaaaugcgagaggauuucgaacuguugaagaaccgggacgucaaugauuaucaccaugccuuugacgcauaccucgcggccuucaucgggaacuaccugcuaaagcgcuaucccaaacuggaguccuacuuuguuuauggagauuucaagaaauucacccagaaggaaacuaaaaugagaagguuuaauuucauuuacgaccucaagcacugugaucagguggugaacaaggagacaggcgagauccuguggacgaaagacgaagauauuaaguauauccggcauucauuugcuuacaaaaagauacuuguaagccacgagguccgagaaaagagaggugccuuguauaaucagaccauuuacaaggcaaaggacgacaaagggucuggccaaggauccaagaaacugauccgcaucaaggaugacaaagagacuaagauuuacggcggguauaguggaaagagcuuagcuuacaugacaauagugcagaucaccaaaaagaacaaaguuucuuauagggugauugguaucccaacacucgcccuggcacgucuuaacaagcuggaaaaugauuccacugagaacaauggcgagcuauacaaaauuaucaagccccaguucacccacuauaaagucgacaagaagaacggggaaauaaucgagacgaccgaugacuuuaaaauugugguuucaaaggugcgguuccagcaacucaucgaugacgccggacaguuuuucaugcuggcuagugauacauacaaaaauaacgcgcagcaauugguaauuagcaauaacgcccugaaggcaaucaauaacacuaauauaaccgacugcccuagagaugacuuagaaaggcucgauaaccugcgccuugacucggcuuuugacgagauugucaaaaagauggauaaguauuucuccgccuacgacgccaauaacuuucgagaaaagaucagaaauucuaaccugaucuucuaccaguugccaguggaggaucagugggagaauaacaagauuacagaacucggcaaacggacugugcugaccaggauccuacagggucugcaugcuaacgcaacgacaaccgacaugagcauauucaagauuaaaacuccguuugggcaacuucgccagcguucaggcaucagucucuccgagaaugcccagcugauuuaucagucucccacaggauuguucgaaagacggguccaacugaacaagaucaaguga

SEQ ID NO: 3197 - RNA, 4137 nt, Artificial Sequence
  Cas9 variant
augaccaacgagaaguacagcaucggccuggacauugggacauccucuauaggauucgccguggucaaugauaacaauagaguuaucagggugaaagguaagaacgcuauuggcguacggcucuuugacgaagggaaagcagccgcggaucgccgaucauuccguacuacgagaaggcggcuuagucgcagaagguggcggcugaaguuguuacgcgagaucuuugacgcuuauauuacccccguggaugaagccuucuuuauccgacugaaagagagcaaucuauccccuaaggacucuaagaaacaguacucgggagauauacucuucaacgacagaucagauaaggacuuuuaugaaaaauacccaacaaucuaucaccugaggaaugcacuuaugacugagcaucggaaguucgauguccgugagauuuaccuggccauccaccauauuaugaaauuucgcggccacuucuugaacgcuaccccggcaaauaacuuuaagguggguagacucaaucuggaagagaaguucgaagaacugaacgacaucuaucaaaggguuuuucccgaugagagcauagaguuccggacagacaaucucgagcagauuaaagaaguguuacuggacaacaagcgaagucgcgccgauagacagaggacccuugucuccgacaucuaccagucuagcgaggauaaagacauugaaaagcggaauaaagcuguggccacugagaucuugaaggcgucccuggggaacaaagcaaagcuaaacguaaucacaaauguugagguggauaaggaagccgcuaaagaguggucaauuaccuucgacagugaaagcauagaugacgaucucgccaagaucgagggacaaaugacggacgauggccaugaaauuaucgagguccugcgcucucuuuacuccggcauaacucugucagcaauugugccugagaaccacaccuugagccagaguaugguggcuaaauaugaccuccacaaggaccaucugaaauuauuuaagaagcugaucaaugggaugacagauacuaaaaaggccaaaaaccucagagcggccuacgacggauauaucgauggugucaagggcaaaguucuuccacaggaagacuucuacaaacaggugcaaguaaaucuggaugacucugcagaggcuaacgaaauucagaccuauaucgaucaggacauuuuuaugcccaagcagaggacaaaagccaauggguccauaccucaccaauugcagcagcaagagcuagaucagaucauugaaaaccagaaggcuuacuauccauggcuggccgagcucaaucccaacccugacaaaaagcgucagcaacuggcaaaauacaaacuugaugagcuggugaccuuccgggucccauacuaugugggaccgaugaucacggccaaggaccagaaaaaucagagcggcgcugaauuugcguggaugauccgaaaggagcccgguaacauuacuccuuggaauuucgaucagaaaguugacagaauggcaacagccaaccaauuuauaaagaggaugaccacuacagacaccuacuugcucggggaagaugugcugccagcucagucguuacuguaucagaaauucgagguccuaaaugagcucaacaagauccgcauugaccauaaacccaucucuauugaacagaagcaacagaucuuuaacgaucuguucaagcaguuuaaaaaugugacgauaaagcaccuucaggacuacuugguaucccaaggacaguauucaaaacggccucugaucgagggccucgccgaugaaaagagauucaacaguagccuguccaccuacucugaccuuugcggcauuuuuggggcaaaacugguugaggaaaaugauaggcaggaggacuuggagaagaucauugaauggagcacaaucuucgaggauaagaaaauauaucgcgccaagcucaacgaccugacuugguuaaccgaugaccaaaaagaaaagcuggcuacaaaacgauaccagggauggggucggcuaucacguaagcuccuggugggccuuaagaauagugagcacagaaacauuauggauaucuuguggauuacuaaugaaaacuucaugcagauccaggccgagccagacuuugcaaaacuggucaccgacgcgaauaaggggaugcucgagaaaacagauucccaagacgugauaaacgaucuguacaccagcccccagaauaagaaagcuaucaggcagauuuuacuggucgugcaugacauccagaacgccaugcacggacaagcaccggccaagauucauguugaguucgcucgcggcgaagaacggaauccuagaaggucugugcagcgacagcgccagguagaggccgcauaugaaaaggucucaaacgagcuugugagugcuaaaguucggcaagaguuuaaggaagccaucaauaacaaaagagauuucaaggacagguuguuucucuacuucaugcagggugggauagauauuuauacuggcaaacagcugaacaucgaccaacuaagcuccuaccagaucgaucacauucugccccaggcguuugugaaggacgauucucucacgaaucguguccugacaaacgagaaucaggugaaagccgacucgguaccaaucgacauuuucggaaagaagaugcuuagcguguggggccgcaugaaagaucaaggguugauauccaagggaaaauaucggaaccugaccaugaauccugaaaacaucucagcucauacugagaaugguuuuauuaacagacaguuaguugagaccaggcaggucaucaagcucgcagugaauauucuggccgacgaauacggcgauaguacacagaucauaucugugaaagcugaccuuagccaccaaaugcgagaggauuucgaacuguugaagaaccgggacgucaaugauuaucaccaugccuuugacgcauaccucgcggccuucaucgggaacuaccugcuaaagcgcuaucccaaacuggaguccuacuuuguuuauggagauuucaagaaauucacccagaaggaaacuaaaaugagaagguuuaauuucauuuacgaccucaagcacugugaucagguggugaacaaggagacaggcgagauccuguggacgaaagacgaagauauuaaguauauccggcaucuuuuugcuuacaaaaagauauugguaucacacgagguccgagaaaagagaggugcccuguauaaucagaccauuuacaaggcaaaggacgacaaagggagcggccaaggaucuaagaaauuaauccgcaucaaggaugacaaagagacuaagauuuacggcggguauuccggaaagagucucgcuuacaugacaauagugcagaucaccaaaaagaacaaaguuagcuauagggugauugguaucccaacacuggcccuugcacgucugaacaagcuagaaaaugauucuacugagaacaauggcgagcucuacaaaauuaucaagccccaguucacccacuauaaagucgacaagaagaacggggaaauaaucgagacgaccgaugacuuuaaaauugugguuuccaaggugcgguuccagcaacugaucgaugacgccggacaguuuuucauguuggcuucagauacauacaaaaauaacgcgcagcaacugguaauuaguaauaacgccuuaaaggcaaucaauaacacuaauauaaccgacugcccuagagaugaccucgaaaggcuggauaaccuucgccuggacagcgcuuuugacgagauugucaaaaagauggauaaguauuucucggccuacgacgccaauaacuuucgagaaaagaucagaaauuccaacuugaucuucuaccagcucccaguggaggaucagugggagaauaacaagauuacagaacugggcaaacggacugugcuaaccaggauccugcagggucuucaugcuaacgcaacgacaaccgacaugucuauauucaagauuaaaacuccguuugggcaacuccgccagcguagcggcaucucacugagugagaaugcccaguugauuuaucagucccccacaggacuguucgaaagacggguccaauuaaacaagaucaaguga

SEQ ID NO: 3198 - RNA, 4140 nt, Artificial Sequence
  Cas9 variant
augaagcagauccugggccucgaccuugggaccacaagcauuggaugggcccuggugagagaggcugaaaacaaagaugagcaauccucuauagucaggaucgguguucgggugaaucccuugacuucagacgaacagaagaacuucgagcagggcaaaaguauuacgaccaaugcagaucgcacauuaaagcgaagcaugcguagaaaccugcagagguacaaacuacggcgcgaccaccucaaggauugccugcaaaagaaugggaucauuacugacaaagccguacuuuccgaaaacggaaauuauaccacauuucagaccuacuaucugagagcgaaggcugugaacgagaaaaucucuuuggaggaauuugccaggguccuccugaugcugaauaagaaacggggcuacaagucgucacgcaagaugaaaagcgcagaugagggucagcucauagacgggaugaguguggccaagcgauuauauaacgauaauaucacuccuggacaguacguucugucccuuuuggaagagggcagaaaauauauuccagacuuuuacaggucugaucugcuagacgagcucgauaagaucuggacauuccaacaguguuuuuacccggaaauucugacccccgagugccggaaacuuaucgcuggcaaggggaaacaggcaacggccaagauauuccugggaaaguauaaaauuuacacugcugacaacaagagcaaagacaagcguuugcaggccuaucaauggcgcguggaagcgcucuccggucagcugccuaucgaggucguggcauuuguaguuugugaaauuaauggcgccauccaggcuucaaguggguacuuaggagccaucagcgauagaucuaaagagcuguauuucgagggccucaccgugggucaauaccuugucaagcagcuggaaaagaacccagacacauccuugaaaaauaagguguuuuauaggcaggauuaccuaaacgaguucgagaaaauuugggagaagcaggcagaauaccauacugagcugacuccccaacucaaaaaggaggugcgggacauaaucauuuucuaucagcgaacacugaagucacagaaagggcuugucggauucugcgaauuugagagccgccagaucgaaguuaugauagauggcaagcugaaaaagaaaaccgugggcuguagaguaugcccuaagaguucuccauuguuccaagaguacaagauuuggcacaaccucaauaaccugaaaaucguggaaaaggaguuagggaaauccagguuccugaaucaggacgagaaggaaagccuauuucaggagcucaacaucaaagaaaagcugucgaaaacggauauucuuaaguugcugugucucaaggcuaaagaguucgaccugaauuuugagaaggucgaaggaaaccggacucaggccgagcuuuuccgcgcguaucaagccaucauugaaaugucugguaauggcgauuacgacuuuuccaaaaugacaucaagugagauacaggauaccgugacugggguuuucagaggacugggcuauaacacagacaucuugagcuuugacgcagaaaaggaggagaaaaccuucgauaagcagcccauguaccuccuguggcauuuacuguauuccuacgaaggugacucuagcgauacggggaauaaggcucuaauuaccaaaaucaagaaacucugcggcuuugagucagaagaguacgccaggauccugacagacgugacuuuccagagugaauauggaaaccuuuccaccaaggcuauucgucggauauugccuuuuaugaaaaagggcagcgaguacucugaggccugucgacacgcaggguauagacauucagaaaggagucugacaaaggaggaacucgauaaaaaggucuacaaagaccaccuggaguuacugccacgcaauagccuucggaacccggugguagaaaagaucuugaaucaaaugauucacguugugaacacugucguggauaccuauggaaaacccgacgagaucagaauugagcucgccagggaacugaagaaguccgcuaaagagcgcgaugaaaugacagcgucuaucaauaagaccgcagccgagcauaaaaaguacugcgagguccuacagaaagaguucgguuuuacucacgugucgcgaaacgacauaauccgguauaagcuguaccucgaacuggaaaacaauggcuacaaaacgcuuuauagcgauacauacauuccucgugagaaguuguucuccaaggaguucgacaucgaacauauuaucccacagucaaaacuguuugaugacaguuucucuaacaagaccuuagaguguagaagcguuaauauagaaaaauccaacgacacugcuuaugauuacgugcucaauaaguauggggagcaaggcauucuggacuacaaaaacaggaucgaaaaucuuuauaaggauucaaagauuagccgcaccaaauaccagaagcugaugaugaaaaacucugacaucuccggaaauuuuauagagcgggaauugagagauagucaguacaucgccaagaaagcaagggagauucucgaggaacugguaaaguucgucgugcccacaaccgguagcguuacugcccgacuacgcgaggacuggcagcugguggaugucaugcaagaacucaacuggaagaaauaugacaagcuggggcuuacagaugugcgguacgacaaagauggcagagagaucagguauauuaaggacuggucuaaacguaaugaucaccgccaccaugcuauggacgccuugacgaucgcauuuaccaagcgguccauaauucaguaccugaacaauuuaaacgcgaagucagacaaaaguggaagcaucuaugcuaucgaacagaaggaacucuucagagauaaaaggggcaagcugaaauuuauuccuccaaugcccugcaauaucuuccgagccgaggcaaagcggcaccuugaaaacguacuggugucgguuaaggccaaaaacaaggucgugacuccgaauauuaaccgcuccaaagggaagaauggaauaaacaaaaagauccagcuaacaccuagaggucaacuccauaaugagaccauuuacggcucuaugaaaagguaugaaacaaagugggagaagaucgggagcggauuugacgagcggcagauugcuaaaguggccaacaagaaauuccgagaagcacuguugucaagacuggcugaguuuggcaaugauccccagaaggccuucacugguaaaaacaguuuagaaaagaauccacucuacgucgacgagcugcacacccagaagguuccugaaaaagugaagaucgugacgcuugagaaccuguacaccauacgcaaagagaucacacccgauuugaagauugacaaaguagucgaugcgggggugaggcguguucuccaagaacggcuggacgaguuugaugacgauuccaagaaggccuucucuaaucuagacgaaaacccaaucuggcugaauggcaaaaagaugaaaagagugacuauuaugggagucagcaacgcugugccccuucaugacaagaaagauuauaagggcaaucucguuuucgacuccaaggggaggaaacagccuguggauuuuguaaacaccggaucaaaccaccacgucgcaaucuaccgcgacgagagcggcgaacugcaggauauaguggugaguuucuaugaggccacaacucgaucuaccuuggguauuccagucaucgacaaggaguacaaaaaggcugaaggguggaauuuucuguucuccaugaaacaaaacgaguauuuuguuuucccgaaugaagagacgggauuuaaccccaaggaaaucgauuuaaugaauccugacaacuacacaaccauuagcccaaaucucuauagagugcagaaauucucgaagugcauguacggcaacucaucuguacgggaguacguguuuaggcaucaccuggagaccagugucaaugauuccaagggucuuaaaaacauagccuauaagaaugugaaaagccugguuuacuuggaaggcaucgugaagguccgcauuaaccauaucgggcagauugugucuguuggagaguauuga

SEQ ID NO: 3199 - RNA, 4140 nt, Artificial Sequence
  Cas9 variant
augagaaucgacaacggccuggaggaacucaaggugaauaacaggauuuacaauauagggcuugauaucggaaccagcuccgucgguuucgccguuacagacgcucaggauaaacuggugcggguaaagggcaaaacugcaauuggggugcgcuuguuugaggaaggacacacggccgcggagcgacguggcuucagaaccacaaggcggcgcuuaucuagaaggaaguggcggaucaaccugcuaaaucaaauuuuugaacccuauaucucagagauagacccuacuuucuuugcucgccucaaaaacaguagccuggccgguaaggauaagaaauucgaggggucccuucuguuuccagaccgaaccgauuaccaguucuauaaggacaauccgacaauguaccauuugagaaaacaccucauggaaaaggauaggcaguuugaccugcgggagaucuaucuggcaaugcaucacauuaucaaauaccguggaaacuuccucaauaccacucccaugaaccauuuuaagaaugaagagauugauuucucugccuuauuuucgcgccugaacgagcuuuaucaggaaaucgacgaugagaauauauucgaauugaacauugagaaugucgacgaaaucaagaaaauucugcuaaaccacgaccucuucaagauggagaaacaaaaacagguggcuaaacugcuuaacguugauacagacgauaagcagcugaaaaaggagaauaccgcauuggccucaaacuuuagcaaggcuauccucggcuacaaauucaaucuggccuuagugacgaagaucccugaccaggauaaaaaggaauggacuauuagucugggcgacgaggauuuugacgauagacucgacaacgucccaguggcgcuuaccgaaucccaacuggagguaguugaaguguugcacucuauauucaauagcaucucccuaaacgagauugucgagaauggggaaacacugucaagugcaauggugaggaaauacaacgaucauaagcacgaccucaagcugcuuaaaaaugugaugacuacccuggaggaccggaagaaagccaagaaaauccagggaauauauaacgucuuuguugguaaggauacagacuugauuagcgauaaggacaaaaauaaguacaaagauaaggacgaguucuauaaagaaauccagaagaaccucgauaauucuuccgacgcugaagagaucauuaagcgaaucaaacaggaucaauuucugcccaagcagcgcaccucaaagaacggcgugauuccucaucaguuacaccaaagagagcuggaccuaauaaucgaaaaucaggccaaguacuauccauuccucaaagaggcaaaccccaacaagaaaaggcugaagcaggcuaaguacaaacuugaugaauugauugccuuuaagaucccuuauuacaucgggccaacgagcggagcggagaauagugacuucucuuggcugaaacggaagaaagauggccagauuacuccguggaacuuugacgagaagguagaccgcauagaauccgccaauagauucaucaggcguaugacaaccaaggauacuuaccuccuggcagaggacgugcuuccccuggaaucauugauuuaugagaaauacucgguccucaacgaacugaauaacgugcggaucaaucgacaaaaguuaucuguuaacgauaaacaggacauuuauaaugagcuguuuaagaacuccaaaacagugacccuaaagcagcuccagaaguacuucgaggucacgaaaaagcugaaaaccgugguaguugaaggucuugcugauccuaagaaauucuugucaaaucuggggacauaucacgacuuuaagcucaucuucggagauauaguggacgauccagaguaccaaacugaccuggaaaacaucauugaguggaguaccaucuuugaagauagaggcauuuucaauagcaaguuaaacgagaucacauggcugacugacgagcagaggaaaaagguccuuuccaaacgcuaucagggcugggggcgguuuucuaagaaauugcucgugggacugaagaauagccaggguaacucaauacuagaugaacuguggaacaccaaucucaacuucaugcaacugcagagucaggacgacuuugccgagcuuauucaugcugaaaaugccaaacaguucaaggcaaacgaucccgacaauccuuggaacggcaucgaugccauuuugaaugacgcuuacacauccccacaaaacaagaaagcgaucagacaggucgugaagguugugcaggauauagagaaagcaauggggaauaagccccagaaaaucgccauugaauuuaccaggagcgcugacaagaacccgcgccgaacugauucucggaucaagcgucugucagacauuuacaaagaggccgcagagaagguagucggagaaaguuuaaaacucgagcugaaugaauaucuuacgagcaagaaaaagaugacagauaagauguaccuguauuucacccaauugggcacugacaucuacaccgguaaaaagauagauauugaccagcucaacaauuaugacaucgaucacgugcugccucaguccuuucuaaaagacgauucucuggacaacagaguucucacaaauaggucggauaacagcgagaaguccgacaccgugccccugcauaaauucggggccaagaugggcaacuuuuggcgccaacuugcugaugagggauugaucacuaagcggaaauacaagaaucugacaacggacccagccaccauugauaaauauacuauccagggcuucauuagaaggcaguuagucgaaacaucacaggugauaaagcucaccgcaaacauccuugggggacuguacccugaggaaacagagauucuggaaauccccgcgaaacuaaaucaccaauuccgagacauguuugaucucguaaaggugcgcgagguuaacgacuaccaucacgcuuucgaugccuauauuacugucuuuguggguaauuuccuguaccggagauauccaaaguugaggaguuacuuuguguauggcgacuucaaaaagcugaacaaaaccgacgaugacauccguaaguuuaauuucuuaaaccucuuuaauaaagauaaggucgaggacaacgaaacggaugagauacuguggucuaaagcagaaagcauccgcgacauuaagaauaucuacaacuauaaguucaugcuuguuucccgggagguguacaccagacacggggccauguuuaaucagacaauuuaccccgcuagcaaaaacgauagcaagaaacugaucccuauaaagaaaggaaaggacacugccauuuauggcgguuacucugggaauaccgaugcauauauggcuaucguggccguagaagacaagaaaggcgagaaguucaaagucgugggaguuccaacaagggcggugucccgauuggagcagcucgccgcugaugaccaugaucaguaccugacugcacuacacgacguccugaagccgaacuucaccaaaaucaagacgaaucggaagacaaaagccaaggaagaggugaccacucccuuucgcauucuuguuggcaaagugggguauagacaacucauacaggacggacagguaaagaugaugcuggguaguagcgcuuacaaauauaacgccaagcaauugguccugucugaaaaguccuuaaaagugaucaagaacaauaaaaaguacaacccugaugacgagaaucaggaucucauugacguguacgaugaaauccugggcgucguuaacagggcauucaaucuuuaugacacaaacggguuucggaaaaagcugaaugauaaccgagugaaauucguagaguugccaauuaauaacaucuuugacggaaccaagcucgugcagaugggcaagagagcgguccugacucagauacuaaauggucugcaugccaacgcugcccuuggggaucucaaagcacugggcaucucaacccccuucggaaagaugcaaaguaaaagcggcauuccuuugucgauggacgcuuccuuaguguaccagucuccaacagggcuguuugagcgcaagcucaaucugagcgaucuuuga

SEQ ID NO: 3200 - RNA, 4140 nt, Artificial Sequence
  Cas9 variant
augaccaagaaaaacuacagcaucggccuggacauugggacaaauuccgugggaugggccgucauaacugaugacuauaagguucccgcuaaaaagaugaaagugcucgguaacacggauaagaaguacaucaaaaagaaucuucugggcgcauuguuauucgacucuggggagaccgccgaagcgacaagacugaaaaggacugcucggcgccgauauacccguagaaagaacaggcuacgguaccuccaggagauuuuugccgaugaaauggcaaaaguagacgagucauucuuucaacgccuggaugaaaguuuccuuagaugggacgaugacaauaagaagcugggaagguauccuaucuuuggcaacaaagccgauguggucaaguaccaccaggaguucccaacaauuuaucauuugcggaaacaccucgcugacagcuccgagaaggcagaucugcgccugguguaccucgccuuagcucauaugaucaaauuucgaggucacuuccugauagaaggggagcuuaaugccgaaaacaccgacguucagaagaucuuuucugacuucgugagagucuacgauaggacuuuugacgauucgcauuugucagagauuacaguggacgcggcaagcauccugaccgagaaaauuaguaagucccggcgucuagaaaaucucaucaaguauuacccgacggagaaaaagaacacucuguucggaaaucuuauagcccuggcuuugggccuccagcccaacuuuaaaaugaauuucaagcugucugaagaugccaaauuacaauucagcaaggacuccuauaacgaggaucuggaggaacuccuuggcaagauuggggacgauuacgcagaccuguuuaccucagcuaaaaauuuguaugaugccauccuacugaguggaauuuuaacaguagacgacaacagcacuaaggcgccucugucugccuccaugaucaaacgcuacgcagagcaccacgaagaucuugagaagcugaaagaguucaucaaggcuaacaagucagaauuguaucaugacauuuuuaaagaugaaaccaagaaugguuacgccggcuacauagagaacgggguuaaacaggacgaguucuauaaguaccucaaaaauacacugagcaagaucgcuggaagugauuauuuucucgacaagauugaaagagaggauuuccugaggaaacagcggaccuuugacaacggcucuaucccacaccagauacaucuacaagaaaugcacgccauucuccgacgccagggugauuacuaucccuuccugaaggagaaucaggacagaaucgagaaaauccuuacguuuaggauuccuuacuauguggggccauuggcacggaaggauucccgcuucagcugggccgaauaccacucggacgagaaaaucacucccuggaacuuugauaaggucauugacaaagaaaagucugcugagaaguucauaacaagaaugacccugaaugaccucuaccugccugaagagaaagugcuuccaaagcauucccacguguaugagacuuacgcggucuauaacgaacugacaaaaaucaaguacguuaaugagcagggaaaagauucauuuuucgacaguaacaugaagcaagaaauuuucgaucauguguuuaaggagaauaggaaaguaaccaaggaaaaauugcucaacuaucugaauaaggaguucccggaguaccguaucaaagacuuaaucggccuggauaaggaaaacaagagcuuuaaugcaucccuaggcacguaucacgaccucaaaaagauucuggauaaagccuuccuugacgauaaggugaacgaggaagucauagaggacaucauuaaaaccuugacacuguuugaagauaaggacaugauccaugagcggcuccagaaguacucugauauuuucacugcugaccagcugaaaaaguuagagcgaagacacuacaccggguggggaaggcugagcuauaaacuuaucaacgguauacgcaauaaggaaaacaauaaaacaaucuuggacuaccucauugaugacggcucagccaaccggaauuuuaugcaacugaucaacgaugacacucuacccuucaagcagauuauccagaaaagucaggugguuggggauguggacgauauagaggcagucgugcacgaccugccuggauccccagccauuaagaagggcauccuccaaagcguaaaaauuguugaugaacuggugaaggucaugggugacaaucccgauaacaucgugauagagauggcuagagaaaaucagaccacaaacagggggcgcucucagucacagcaacgacuuaaaaaguugcagaauagucugaaagaguuaggcagcaacauccucaaugaggaaaagccuuccuauauugaggacaaggucgaaaacucucaucugcagaaugaccagcuuuuucuguacuauauccaaaacggaaaagauauguacaccggcgacgaguuggauauugaccaccucucggauuaugacaucgaucauauaauuccacaggccuucaucaaggacgauagcaucgacaaccgggugcugacuuccucagcgaaaaaucgugggaagagugaugacguucccucucuagauauugugagagcaaggaaagcugaguggguacgccuguacaagagcggacucaucuccaagcggaaauuugacaaccugacgaaggccgaaagagguggccuuacagaggcagacaaagccggguucauuaagaggcaguuggucgaaacccgacagauaacuaaacacguggcucaaauccuggaugcccgcuuuaauaccgagucagacgaaaacgauaagguuauucgggacgugaaggucaucacauuaaaaagcaaucucgugucucaguucagaaaggauuucgaguuuuacaaaguaagggagauuaacgacuaucaccaugcacacgaugcuuaccugaaugccgugguuggaaccgcgcuucugaagaaauauccgaagcuagccuccgaguucgucuacggcgaauauaagaaauacgacgugcauaagcucaucgcuaaaaguagcgaugaccacucugaaauggguaaggcaacugccaaauacuuuuucuauuccaaccugaugaacuuuuucaagcgugugauacgcuacucaaaugggaaagucaucguucggccugugguggaguauaguaaggauacagaagacauugcuugggauaagaaaagcaauuuuagaacgaucugcaagguauugucguacccccaggucaacauugugaaaaagguugagacccaaacuggcggauucuccaaagagucuauccugccaaagggcgacagcgacaaguuaauaccuaggaaaacaaagaaagccuauugggauaccaagaaauacgggggauuugacucacccacaguggcauauagugucuucgugguugcggauguggaaaaggguaaggccaaaaagcucaaaacuguaaaggagcuggucggcauuuccaucauggaacgaucuuucuuugaggaaaauccaguggaguuccuugagaacaaaggguaccauaauauccgggaagacaagcugauuaaguugcccaaauauagccucuuugaguucgaaggaggcaagcgcagacugcuagcuuccgccucagagcugcagaaagguaacgagauggugauaccugggcaccuugucaagcuccuguaccacgcacagaggaucaacagcuuuaauaguaccaaauacuuggauuauguuucugcucauaagaaagaguucgaaaaggugcuguccuguguagaagacuuugccaacuuauacguggaugucgagaagaaucucagcaaaauucgggcaguggccgacucgauggauaacuucucaaucgaagagauuucuaauaguuuuaucaaccugcuuacgcugaccgcuuugggcgcgccagccgacuucaauuuucucggagagaagauaccgcgaaaaagauauacauccacuaaggaaugccugaacgcaacccuaauccaccagagcauuacaggccuguacgagacucgcaucgaucuuucuaaaauuggggaagaguga

SEQ ID NO: 3201 - RNA, 4143 nt, Artificial Sequence
  Cas9 variant
augggcaaguacaaccuggggcucgacaucggaaccaauagcguggguugggccgucguugaugagaacaaucagauugugaaaaagggcgggaaagcucuuuggggaguaagaauguucgacgaagcacaauccgccaaggagacaaggauauaucggaacucucgccgacguaucgugagaaggaaucagcggcuguuguuacugcagaaagaauuuuacgaugagauuaucaaggucgaccagacuuucuuucaacgccuaaaggauucauucuuuaaaaaggaagacaaacucaacaagaauaacuauacguucuuugaugacgauauuaccgacagagaguacuucaaaaaguuucccacaaucuaucaccugaggagucaucuucuguacaaugaugagaagauagacauccggauguuguaucucgcgcugcaccauauugugaaauaccgcggccacuuccuggauagcggugaaguuaacgaguccaauuuuucuaagaucaaagacgugcucgacacuuucaacaauaagaugucggaaaugucauuagaguuugaggauaacgaagacuacuucugcaaaauugaguucgaugaaaauuuugagaacaagcugaaagacaucaugcuuagccaguugaguaagaaggaaaaacgacaggagcugauagaucuauucaaggucgacaaaaagucccucgugaacgagcugcuuauugaacuguugguaaauaaaaagguuaagcucaacucucugagcaucaccaaugggaaaaaguaugaggugugugaaauugauuuugagaaagaagaguuauucgagaagcuggaagacgcuaaaaagaucaucacagagcucuuugauauucuugacgaaauagucaacaucaagaaaauuguggauuacuauuacgugcugaagaucauaggagacaaugaguauuuguccgaagccauggucaaaaaguacgacaaacaugauaaggaccuaagagagcugaagucauucauuaaaaccuauugcccuaacaaguacuacgaguguuuuaggaaaacaaguaauccaaaccucugcaauuauccgaaguacguuggcaucaacagcgugaauaaaaagaucgaacgguucgcacacuguaaaaaggaggaauuuuauaaguaccugaaaucucuuuucaacacuauuaaggaugagaaugccaaacugaagaucgacuuguuucagaaagauauggagaacgacgauuuccucaaucgucaaaacuccaaccacaauucaagcauucccaugcagcugaacuuuugcgaauuaaagaagauacuggagaaucagaguaaauauuacccuuuccuaaugcucaagaacucugacggcuauuccaccagcgaucgcaucauugcuaucuucaaauacaagaucccauacuauguagggccccugaauaaaaacucgaaguacucuuggcuugugaagaaauccaaugaaaacauuacgccuuggaauuaugagaaggucauagacuuggaugcaucagccaaagaauuuauccagagaaugcaaaacaaguguacuuaccugaaaggagagaaugacuauugccucccaaagaagaguauucuguucagcgaguacaacugucuucaguaucugaauagguugaucauuaacggugcucucaucgaaaauaaacugaagaacgagauauacgaaaacaucuuuuuaugcuacaaaaagcccaccaaaaaguccauuguggaguaucugaaaacaaauuacaacuaugaugaaacuacccuaaagucuaauauccucgagguuaacugugacaugagcucauacauucaguucaaggagaucuauggcgaagacuuugagcaaaaucugaacauaguggaagauauuaucaaagacauuacaaucuucgaggauaagaaaauacuugaaaagcgguugcgagagaucuaccaucugagugaggacaaaguccagaagauuaaggggcucaauuauaaaggauacgccacccuguccaagcacuuuuuaaacaauuucuacagcgugaacgaagagacgggcgaaaucuaugguccuauuauccagauaaugcgcgauacuaauuacaaccugcagcaaguaauuuauaaugacagauacaacuuuaugaaagcgaucgauaaguauaauaaaaagaaccuugacacagagaagaaauugaacguuucugauuucaucgacgaguacauuuaugugucaccaaucaugaagaggagucucauucagagcuacaauauaauccaggaacuggagaaaauucuaggggaauccaucucuaaguacuauauugagugcgcacggguccgcucgaacagcaaagaugugaucaauuccagauacaggcagcugucagaacucuauaaggacugcgagcaucaagucagugauauaucuaagaacuacaucaauauuaacaaacugaagaaacagcuugaggacaauaagaacgaauugcgugccgacaaacuguauuuauacuuuacccaguucggaaaguguauguauacucucaaggauaucgaccuggaugacguguuucuuggcaaauacgauauugaccacaucuacccgcagagccugauaaaggaugacuccuugaauaaccggguucucgcuucaaaagagaagaauggcaaaaaggauaaccaauucauuuucaauauccccgaauuucugccuaaaaacgccgagcuauucuauaagaagcugcucgaaugcaaacugaucacaaaggagaaauaccgaagacuuaccaugaagaaaauugacgaugacgaguuggacauauuugugaauaggcagcugguagcaacgaaccagagcgucaagggguuaguggauguucucaagaucuauaaaggagugaagccaaccaauauugucuacucuaaagcugugaacaucuccgacuuccgcaacaauuauaaccuguacaagagucggacagccaauaacuaucaccaugcgcacgaugccuaccuuaauguagugauugguaaagcacuggacguuuacuaucaguguaacuacuuucaaaauuauaaggaugucaucaagcuaaaagacagaaacauaacuaucaaucccgaaauuauccucagcaagaacagguacgugaaucgcaacggcgagaaaaaggugauuugggaucuggacaauaccuugaaacugaucaagaacaauuuauauaaccgauucgauauaacagaaacuauuaugacccggaagucuaacaaaauguuuuccaagucaaguaucagcccugcuaaaaauucgaagaaccucaucccaauuaaaacauccgacccccguugcaauguccugaaguacgggggaaucaaaucuaacagcuauaauuucuacuguauaguugagcuuuacgauaagaagggcaaaaagucauauauucuggaagccaucccgaaaacccauagugacaaguuggaggaguacauuaaaaacuccaucgaugaaaagaaugugucuaacuuuaagauaauuaauaaaaacaucaagagcaauaucauuaucgaguauaaaaagcucagauacgugauuacugguaaauccgggaaguauuaccugauaaagaacuucaaagacaggaauuuuucauauaacgcuaucaagacgauuaaauacaucgaaaaguacaauuaucagaaaaaguacgagaucccuuucgaggaaacaaaggagaaaauuauacuagcccccaagaaaaaggacaccaaagaaaucagccugacucuugauaacugccaggcacuccuggacgagauuaucaguuuguucaagaaagauauuuauaacuacgacaucauauauaagaucaccucuaagcuggaagagaauaaacaaaacuuaacacucaccaaucugauuaagguacuuacugagauccugauuuugcucaaaacaaacgaacgcggcacggccgaucugacccuaaucgacauguccaaggauacuggaacacuguguauaagcaaaacccuuaagccaggcaugaaguuuauuucggagucaccuacaggguacuaucggaaaaucauuuucgaaguccccaauggaaucuga

SEQ ID NO: 3202 - RNA, 4143 nt, Artificial Sequence
  Cas9 variant
augaagagaauccugggccucgaccuugggaccacaagcauuggaugggcccuggugaacgaggcugaaaauaacaaugaggcauccucuauagucagguuggguguucgggugaaccccuuaacuguagaugaaaaaucaaauuucgagaagggcaaagccaucacgaccaacgcggaccgccagcugcgacacggggcucguauuaaucuacaaagauacaagcucaggcggcagaaccugcaugauugccuucagaaacagggauggcugggcacagaagccauguaugaggaggguaaggcaaguacuuuugaaaccuacaaguugcgcgccaaagcugcagaggaagagaucagccuccacgaguucgccagagugcuguuuaugcugaauaagaaaaggggguauaaguccaaccggaaagcuaauaacaaggaagacggacaacucuucgauggcaugacaauugccaagaaauuauacgaggaacaucugaccccugcggaguauucucuucaguugcugaauaagggcaaaaaguuuacucagggguacuaucgcucggaccuaaacgcagaacucgagcgaaucugggaugagcagaaaaaguacuacccagaaauacugacagacgaguucaaacaacagcuugaaggaaagaccaagacgaauacuucaaaaaucuuucuggccaaguaugguauuuacagcgcugauuugaaaggccucgacagaaaguuccagccgcugaaauggagggucgaggccuuacagcaacagguggauaaggaaguucuggcauuugugaucagugaccucaaggggcagauugcuaacaccuccggacuucugggcgccaucucugaucggagcaaagaguuguauuucaacaagcaaacagucggucaguaccuaugggcgucccuggaggaaaauccccacauaucaauuaaaaacaagccuuuuuaucgucaggacuaccucgacgaguucgagaaaaucugggagacucaggccgcauuucauaagcaacugaccccagaacuuaagcaggagauucgcgauaucaucauuuucuaucagagaccccugaaaaguaagaaaucuuugauaagcgugugugagcucgaacagaggaagguaaaagcuacaaucgacgggaaggagaaggaaauuaccaucggaccuaaaguugccccaaaguccucacccguguuccaagaguuucggauauggcagaaucugaacaaugucuuacugauugauaacgacacgaaugagaaacgaccucuagaugaaguggagcgcaaccuccuguacaaggaacuuagcaucaaagcuaaguugaguaaaacugaggcccugaagauccucaauaagaaaggcaagcagugggaccugaacuacagagaacuugagggcaauaggacacaggcaauucuguucgauugcuauaaccggaucauuaccuugacugggcacgaggaaugugacuuuaaaaagauaaaagccucugagauccgccacuacguguccacaauuuucaagaaucucggauuuagcaccgaaauccuggauuucgacccaucguuaaagaaacaugagcuggaaaagcaaccgauguaucagcuauggcaccuccuguacucuuaugaguccgauaacucaagaacggguaaugagagucuuuugaggaaacuggaaaccacauuuggcuuccccgaggaauacgcuacuguccucugcgacguuguguuugaggaagacuaugggaaccugagcguaaaggcgaugcgugagaucuuaccuuaccugcaggcaggaaacgauuacucccaggccugugcuuaugccggcuacaaucauucucggcacagccuuaccaaagaggaauuggaccaaaagguguauaaggagcgacucgaacugcuaccaaagaacucacugagaaaucccgucguggagaagauucucaaccagaugauaaauguuaucaacgcaauuaucgaugaguacgguaaaccugacgaaauuaggaucgagauggcccgcgaacugaagaguuccgcugccgaucggaaaaagacaacucacgcaauaagccaggggaaugcggagaaccaaagaaucagggaaauucuugagaaggaguucucuuugucauauaucagucgcaaugacauuaucaaauacaagcuguaugaagaguuagaaccaaacuacuacaaaacccucuauagcgauacauacauaaccaaggacaaacuguuuuccaaggauuucgacauugagcauaucauucccaaagcucgacuuuuugaugacucuuucucgaauaagacucuggaagcccggaacaucaauuuggaaaagagcaacaaaacggcauucgauuuuauaaaggagaaauauggcgaagacggagccgaggcuuacaagaaaaagcucgacaugcugcuagaaaaugaugccaucucccguccgaaguauaacaaccugcucagagcagaggcugacauuccuucagauuucaucaauagggaccugcgcaacacacaguacauugccaaaaaggcgugcgaaauccuuggcgaguuggugaaaaccgucacucccaccacagggaagauaaccaaucggcugagagaggauuggcaguuaguggacguaaugaaagaacucaacuuugagaaguaugaaaagcugggacuuacugagauuguugaggauagggacggucgaaaaaucaagcgcaucaaagauuggacaaagcggaaugaccacagacaucacgccauggaugcucuggcaauugccuucacgaaaccaaguuuuauccaguaccuaaacaaucucaacgcuaggucuaauaagggcgacagcauuuacgccauagaaaacaaggagcugcauuaugaagaggggaaauugcguuucaaugcaccuauccccgugaacgaauuucgcgcggaggccaagcggcaccuguccgcuauuuuagucucaaucaaagccaagaauaaagugaugacccaaaacgucaauaagauuaagacuaaacacggaaucauaaagaaaauccagcucacaccaagaggcccccugcauaacgagaccauuuacgguacaaagaugaggccuaucauuaaaauggugaagguuggggcagcucuugaugaagccacuaucaacaaagugagcucuccagcaauacgagaggcccuguugaagcggcucaaugaauauuccggcaacgcuaagaaagcguucaccggaaagaauacgcuggagaaaaacccgauuuaccuaaaugccggccgcaccaagacaguacccagucuggucaaaacuguggaaugggagagcuuucacccuaccagaaaacuuaucgacaaggaccucaacguugauaaaguggucgacaaggggaucagggagauucugaaagcacgguuggaagaguucaauggagaugcuaagaaagccuuuucuaaccuggaagagaauccaauauauuuagacgaagccaagaagaucgcucucaaacgaguguccauugaggguguacugucagcaaucccccuucauacacugaagaaccaggccggcaaaccuauuacugggaaggauggaaaaccaguguugggcaauuacguucagaccaguaacaaucaccacaucgcguucuauuacgacgaggaugguaaccuccaagacaaugcugucagcuuuuucgaagccgcagagagaaagucgcaggggauacccgugaucgauaaggacuacaaccgcgauaaaggcuggagguuccuguuuacgaugaagcagaaugaauauuucguguuuccgaacgaggccacaggauucauuccuuccgaggucgaccuaaccgacgaagcuaacuacggcaucauuucuccaaaucuguaucguguucagaaagugagccggaucgauaaggggacuucagcaaguagagacuacugguuuaggcaucaccuugagacaauacucaacgaugacgccaaacugaagaauuuggcguucaaacgcauucgaggauuacuggaacucaaggauaucaucaaggugagaauuaacuccaccggcaaaaucguagcugucggugaguaugacuga

SEQ ID NO: 3203 - RNA, 4143 nt, Artificial Sequence
  Cas9 variant
augaagaaaauccugggccucgaccuugggaccacaagcauuggaugggcccuggugaacgaggcugaaacugaguccgaaaagucuucaauaaucagauugggugucaggguuaaucccuuaacgauugaugagaaaggcaacuucgaaaaggggaaagcaaucaccacaaauagugaccggcagcaacgccacagcgcccgaauuaaccugcagcguuacaagcuaagaaggcagaaucucugcgauugucugcagaucggaggccuucuggguuccgagucuauguaugaggaagggaaggagucgacuuuugaaaccuacaaauugcgggcgaaggcugccacagagaaaguggcacuccaugaguucgcccgcauacuguuuaugcugaacaagaaaagaggauauaagucaaauaggaaggcuaacagcaaagaagacggccaagcauucgauggcaugaccaucgccaagaaacucuacgaggaaaauuuaacuccugcugaguauagucugcagcuuuugaacaaggggaaaaaguuuuccccaucuuacuaucggagcgaccuggaauccgagcuaaaucgcauuugggaggaacagaaaaaguacuacccggagauccucacagaugacuucuaucagcaacuggaaggaaagaccaaaguaaacacgacuaagauuuuucuugccaaauacgguaucuauaccgcggaucugaagggcuuggacaaaaagaugcagccccucaaguggcgaauagaggcacugaauaaacagguggauaaggaagucuuaacauucgugguuucagaccugaaagggcagauugagaagacaaguggacuccuuggcgagaucagcgauagaucuaaagaacuguacuuuaacaagcaaaccgugggucaguaugucugggccuccuugaaggagaauccucacgugucaauuaaaaacaagccauucuacaggcaggacuaucuagacgaauuugagaaaaucugggaaacacaagcugccuuccauaaggagcugacccccgagcucaaaaaggaaauccgggauauuauaaucuuuuaccagcguccucuaaagagcaaaaaggggcuuauuaguaucugcgagcuggaacagaaaaaggagaaaguaauaauugagggaaaggaaaaagagaucuugaucggcucuaagguugcaccaaaguccagccccauguaccaggaguuccgcauuuggcaaaaccucaauaacgugcuguuaaucgacacggaaauuaaugaaucgagaccucuggaugaggaggaaaaagcucuacucuauaacgagcugucugucagggccaaacuuuccgaaacugaggcguugaaaacaauaaauaagaaaggcaagcacugggaccugaacuucaaggaacucgaggggaaucggacccaggccgugcuguuugaguguuacaaccgaaucauuacucagacaggacaugaagagugcaauuucaaaaagaucucagcagaagauauccgccacuauguggcuaccauuuuuaaaaaccuugguuucaauacggacauacuggauuuuaacccaaguuuggagaagcacgaacucgagaaacagccgauguaccaacuguggcauuuacuguauagcuacgaguccgacaagucuagaaccggcaaugaaagccuacucaacaagcuggaggccaauuucggguuuccccaggaauaugcuucaguccuugccgaugcaacauucgaggacgauuacggaaacaucaguguuaaagccauuaggaagaucuugccucaucugcacgacggcuacgacuauuccgaggcuugugaacgggcggguuacaaccacagcgugcgcucucucacuaaagaggaacuggcacagaagguauauaaagauagauuagaccugcuuccaaagaacucauugaggaaucccguggucgagaagauucucaaucagaugaucaacgugauaaaugccaucauuguugaauacgggaaaccugaugagauccguauugagauggcucgggaacugaagaguagcgccgcaaaacgagaggaaagaaccaaguccaucaaccaaaaugccgcugagaacaaaaggauaacagaaauucuacagacugaguuuggccugucuuauaucucgcgcaaugacauugugaaguacaaacucuaucaggagcuggaagccaacggauucaagacccuuuacagcaauacauacaucccaaaggagaaauuguuuuccaaggauuucgacauagaacacaucguccccaaagcacggcuguuugaugacucauucggcaacaagaccauugaggcgagagaugugaauuuagcuaaaaguaacaagacugccuucgacuuuguaaaggaaaaauauggggagcagggaaucgaggaauacaagaaaaagcucgauacgcugcuuaaagagaaugcaauuucuagcgguaaguauaagaaacugaugauguccgaagccgacaucccgucagauuucauaaacagggacuugcgcaacacacaauacauugcucgaaaggccuaugagauccucggcgagcugguuaaaaccaucacuccuaccacagggaagauuaccgaccggcuacgugaagauuggcagcugaucgacgugaugaaagagcucaauuuugaaaaguacgauagacugggacuuacugaggucauugaagacagggauggccgcaagauaaaacggaucaaggacuggacaaaaagaaacgaucauaggcaccaugcaauggacgcuuugacgauugccuucaccaagcccagcuauauccaguaccugaauaacuuaaaugcgcgaucugauaaauccgguaguauuuacgccaucgagacuaaggagcuccaccgcgaaaacaauacacugcgguuuaacgcuccaaugccucuuaaugaguucagaaaggaagcaaaaaggcaucugagcgccauacuggugucuaucaaggcuaaaaacaaggucaugacccaaaaugugaacaaaauuaagacuaaaaaugggaucauuaagaagguucagcucacuccccguggcgcccugcacaacgagaccaucuauggaacgaaaaugcgcccaauaauuaagauggugaaaaucggcgcagcguuggacgaagccaccaucaauaagguauccucacccacaauucgggaggcucuguuaaaaagacucaacgaguacaguggggaugccaagaaggcauuugcuggaaagaacgccauaacuaagaauccuaucuaucugaacgcagaacacaccaaaacagccccagcuauggucaagauuguggagugggaaauguacuauccgaucaggaaacuuauuacucccgaccugaagaucgagaagguuauagauaaugguaucaaagaaauuuugaagaaacgacucaaggaguucggcggggacgcgaaaaaggccuuuagcaaccuggacgagugcccuaucuaccuagaugaagagaagaauauuacccugaaacgggugucgaucgaaggaguccuuuccgcaauaccagugcauacgcucaagaaccacgcuggcaaagagauuaaggacgaggaugguaaagccguacugggggacuaugugcagacaucuaauaaccaucacguugccaucuaccaggaugcuaagggcaauuugcaagacaacgucaucagcuucuuugaagcagccgagcgcaaaucacagaaugugcccauuguggauaagaaccugaauagagacaagggauggcacuucuuauacaccaugaaacagaacgaauauuuugucuucccuaaugaggaaacuggcuucguuccaagugagaucgaucucauggacgagaacaauuacgaaaugauaucccccaaccuguuuagggugcagacaaugucucggguggauuaugggaagaccauuauccgagaguacguauucagaaaccaucuugaaacuauucugaaugacaacuugaaacucaagggacuggucuuuaaaaagaucaagagccuaaaagcgcuggagggcauagugaagguucgcgugaaugcuauugguaaaaucgucgccgugggggaauaugacuga

SEQ ID NO: 3204 - RNA, 4143 nt, Artificial Sequence
  Cas9 variant
augaagaaaaaguacgccaucggcauugacauagggaccaacagcgugggaugguccgucguuacagaugacuauaaagugcccucuaagaaaaugaagguauucgguaauacugagaagagauacaucaaaaagaaccugcucggcacgcuucuguuugaugaagggaauaccgcugagaacaggcgguugaaacgcacagcacgacguagauauacuaggcggcgcaauagaauuuuauaccugcaggaaaucuucgccgaggaaauuaacaagaucgacgauucauuuuuccaaaggcuagacgauaguuuucucauaguggaggacaaacagggaagcaagcacccuaucuucggcacccugcaggaggaaaaggaguaucauaaacaguuuccaacaauuuaccaccuucggaagcaacuggcggauuccucucagaaagcugacauccgcuugauuuaucucgcccuggcacauaucauaaaguaccgaggucacuuccuguuugaaggggaucucaaaucggagaauaaggacguccagcauuuauucaacgauuuuguggagauguucgacaaaaccguugaaggaucauaccugagcgagaaucuuccgaacguggccgacgucuugguggaaaagguaaguaaguccagacaccuggagaauauucuacacuauuuucccaacgagaaaaagaauggccucuucggcaacuuccuggcucuugcacugggguugcagccuaauuuuaaaacuaacuucgaacucgccgaggaugcuaagauccaauuuucuaaagaaacauacgaggaagaccuggaggaauuacugggaaagauuggugaugacuaugccgaucucuucaucgcgaccaagagccuuuacgacggcauccuguuggcagggauucuauccacgacuaacucaaccacaaaagccccacugaguagcucuaugguuaauagguaugaggagcaucagaaggaucucgcucugcuuaaaaacuuuauacaccagaaucuguccgacucauacaaggaaguguucaacgauaaauugaaggacggauaugccggcuacaucgaggguaagacuacccaggaaaauuuuuaccgguucauuaaaaaggcaaucgagaaaauagaugggagcaacuauuuuauugaaaagaucgagcgugaggacuuccuccgcaaacaaagaacauuugacaauggaaguaucccccaucagauucaccugagggaaaugcaggcuaucauucggcgacaagccaaguucuacccuuucuuagaggaaaaccaggauaagauagagaaaauccugaccuuccgcauuccauauuacgucggcccccuagcgagaggcaagucugaguucgccuggcucaauaggaaauccgacgaaaagauccggccuuggaacuuugaugagaugguggacaaagaaacgagcgcagagaauuucaucacucgcaugacaaacuaugaucaguaccugccagaccagaaggugcuuccgaaacacucguugcuguaugaaaaguuugcugucuacaaugagcucaccaagguuagauacgugacugagcaagggaaaucuuucuuuuucgaugccaacaugaagcaggaaauuuuugacaggacauucaaaguauaucguaaggugaccaaagagaagcugauggauuuucuuuccaaggaauuugacgaguuucggauagucgaucuguugggacucgacaaagauaauaagucauucaacgcuagucuggguacguaccaugaccugaaaaagaucgugagcgaagacuuuuuagauaacuccgagaaugaggacauucuagaaaacguugugcucacccugacacuuuucgaggaucgagaaaugaucagaaaaagguuggagaaguauaaggacguccugacugaggaacagcgcaaaaagcucgagcggagacacuacaccggcugggggaggcugucugccaaauuaauuaauggaauccgcgauaaggugacacgaaaaacuauacuggacuaucuuaucgaugacggcaccagcaaccggaauuucaugcaguugauuaacgaugacacacucucauuuguagaugaaauccgucuggcacaagguagugggaaggccgaggacuacagagcugaaguucagaaucuagcgggcucccccgcaauuaagaaaggaauccugcagagccucaagauaguggaugagcugauugaggucaugggcuaugacccugaacauaucguggucgagauggccagggaaaaccaguucaccaaucaagggcgccggaacucucagcagagauacaaaaagauugagaaugcuaucaaaaaccuugacucaaauuugaacaguaagauacugaaagaauacccaacuaauaaccaggccuuacaaaacgauaggcucuuucuguauuaccuucagaauggaaaggacauguauacggaugaggagcuggacaucgaucaguugagccaauacgacauugaucacaucauuccccaggcauucaucaaggacgauucccucgacaacaaagugcugacaaagucugccaaaaaucgagguaagucggaugacguuccuagccuagaaauaguguauaaaaagaagaacuuuuggaaacagcugcucgacucccagcugauuucacaacgcaaguucgauaaucuuaccaaagcugagcggggcggguugacuaacgaagacaaggccagauuuauccagaggcagcugguagagacccgucagaucacaaaacaugucgcacgcauuuuagauacccgguucaauacuaagcucgacgaagcgggaaacagaaucagggauccaaaggugaauauuaugacacugaaaaguucucuuguuagccaauuucgaaaggacuaccagcuguauaaagugcgggagauaaacaauuaccaccacgcucaugaugccuaccuaaacgcagucguggccacggcucuccugaagaaauauccccaguuggccccggaguucguauacggcgacuauccuaaguacaauuccuauaagucacgcaaaagcgcaaccgaaaaggugcuguuuuacucuaacaucaugaauuucuucaaaagaguuuuagucuauuccaagacuggugaggugaggauucggcccgugaucgaagucaacaaagagacaggggaaauuguuugggauaagaagagugacuuucgaaccgugagaaaagugcucagcuacccacagguaaacgucgugaagaaaacagagguucaaaaucacggccuggaucgcggaaagccuaaaggcuucuacaacgcuaaucuuucucccaggccaaaggagggguccguggaaaaccugguccccgccaaacagucauuugacacuaagcguuauggagguuacgcgggcaucaguaauagcuaugccguguugguuaacgggauaaucgagaagggcaaaaagaaaucgaaggcugaagugaccgaguuccagggaauuuccauccucgcacggaaagauuuugacaagaauccuaagcaauaccugcuaaaccuggguuauaaagacauuaagucuaucauaaaacuuccaaaguacagccucuucgagcuggaaaaugggucaagaaggauguuggccaguauucuguccacgaacaauaaacgcggcgagauccauaagggaaacgaaauguauuuaccggauaaguuuguaacccuccuguaccacgcuaugcgagucaauagaacacuugagcccggccacaaaaaguacguggaagcccaucggcacguguucgacgagcuguugacuuauauccucgaguacaacgagaaaauugucggggcaaaggcgaauggaaaaaggauaguugaagccuauucugcucgcaaggauaccgacaaccuggaggaacuaugcaauagcuuuaucaaccugcuuaaccucacagcccugggcuccgcaguggauuucgaauuuuuggguacuaagauuccucguuacagagacuauaccccaagcucauuacugaaagcuacgcucauccaucagaguguaacagggcuguacgagacccggauugaucuuucuaagcugggaggcgacuga

SEQ ID NO: 3205 - RNA, 4143 nt, Artificial Sequence
  Cas9 variant
augaagaaaauccugggccucgaccuugggaccacaagcauuggaugggcccugguguacgaguccgaaaacgcugaugagaagucuucaauagucagauuggguguuagggugaaucccuuaaguguagacgaaaaaggcaacuucgagaaggggaaaagcaucacuacgaaugcagaucggcagcaaacccacggagcccgcauuaaccugcagcgauauaagcuacguagagaaaaucucaaggacugccugcagaaacagggcuggaucgguacagaggcgcuuuacgaggaagggaagacuuccaccuuugagacauauaugcugagggcuaaagccgcagaagaggagauuucuuugcaugaacucugucgggugcuguucaugcugaacaagaaacgcggauacaagucgaauagaaaggccaacaauaaagaggauggcaagcucuuugacggcaugaccgucgcuaaaaaguuauaugaagaacaccugacuccugcagaauacucacuuaaauugcugagcagugggaagaaauucaagcaagaguauuacagguccgaucuaaaggaggaauuugaccggaucuggaacgagcagcagaaauacuauccagaaauacucacagaugacuucaagcagcaacugcagggaaaaucuaaggguaauaccagcaaaaucuuucuuggcaaguacgggauuuauuccgccgaucugaagggauuggaccgcaaacuccagccgcugaaguggcgaguggaggcuuuaaaacagaagguugauaaagaagugcuggccuucgucaucucagaccucaacggccaaauugcgaguacgagcggucuucugggggcaaucucugacagauccaaggaguuguacuuuaauaagcagacugugggacaguaucuauggaccucacugaaagagagcccccauguaaguauaaagaacaaaccuuucuacaggcaagauuaucucgacgaauuugagaagauuugggaaacacaggccacuuaccacaaagagcugaccccagaacuuaagcaggagauccgggauauuaucaucuucuaccagcguccccugaagucuaaaaagggcuugauuuccguuugcgagcucgaacaacgcaaagugaaggucacaauagacggcaaagagaaggaaaucagcauugggccuaaaguggcuccaaagucgucucccauguuucaggaguucagaaucuggcagaaucugaacaacauauuacugauugauaagggaaauaacuccaauaggccucuauaugaggaagaacggaaccuccuguacgaagaacuuucagugaaagaaaaguugaguaaagccgaggcacugaagguccucaauaaaaacgguaagcagugggaccugaauuauaaggagaucgaaggcaaccgaacccaagcuguucuuuacgauuguuauaaucgcaucauugggaugacgggacaugaggaaugcaacuucaaaaagcugaaagccagcgacaucagauacaaugugaagacuauuuuuaaaaacuugggcuucuccacagauauacucgacuuugauucuagccugcagggucacgaguuagaaaggcagccaucauaucagcuguggcaccuacucuacaguuacgaguccgacaauagccggaccgggaacgacgcgcugcuucgcaaguuggagacugccuucucuaucccgaaggaauaugcagcuguacugucagauguggucuuugaggacaguuacggcaaucucagcgugaaagccaugagaaacauucugccccauuuacaagcuggacuggauuauucccaggccugugaaaaggcaggcuacaaacacucuaggcguucgcuuacaaagaacgaguuggacaaaaaggaauauaaggagaaacucgagcugcuaccuaagagcucccugcauaauccaguuguggagaaaauccucaaccagaugaucaaugucauuaacgccgugauagaugaguacgggaagcccgacgaaauccggauugagcuggcucgagagcuuaaaaucggagcggcagaaagagagaauaugaccaggucaauuaaccaggguaaugccgaaaacaagcgcauccgggagauauuggaaaaagaguucgcucugaguuauaucucuagaaaugauauuaucaaguacaaguuauacgaggaacucaaaagcaacggcuuuaagacgcuguauuccgacaccuacauuucaaaagauaaacuuuucagcaaagacuuugauaucgagcacauaauuccuaaggccaggcuguucgacgauucuuuguccaauaagacaaucgaagcacgcgacguaaacauugccaaaaguaauaagacugcuuuugacuucaucagcgagaaauaugaucaacaggggauagaagccuacaagaaaaagcucgacauccugcuacaggauggaucuauuuccaaggcaaaauauaaccgacugcucaugaaggaggcggacaucccaucaggcuuuauugaucgggaccugcgugauacccaauacaucgcuaaaaaggccuaugagauacuuagugacuugguuagaaaugugacacccacuaccggugcagucacaagcaggcugcgcgaagauuggcaguuaguggacgucaugaaagagcucaacuucgaaaaguaccagaagcuggggcuuguggagguuauugaagaucgggacggcagaaaaaucaagaggaucaaagauuggaccaagcgaaacgaccaccgccaucacgccauggacgcucugacuauugccuucacgaaaccgucguacauccaguaucuaaauaaccucaaugcacgguccgauaagaacucuagcauuuacggaauagagaauaaggagcugcauagagaagacaacaaauugagguuuaaugcuccucugcccaucaacgaguuccgugccgaagcgcgccggcacuuaaagucaauucucgugaguguaaaagccaagaauaaagucaugacacaaaacgugaauguuaucaagaccaaacauggcgugauuaagaagguccagcugacuccaagaggggagcuucacaacgcuaccuuuuauggaacaaagaagaggccuaucauaaaaauggugaagguaggugcagcccuggaugaggugaccaucaaaaagguuuccucuagcuucauucgagaggcuuugcucgaccggcugcacgaguacaauggcgaugccaagaaagcauuuacugggcgcaacuccaucgacaagaaucccauuuauaucgaugaggagcauaaaaagacagucccagcgcuagugaaaacgauagaaugggagauguaccaccccaccagaaagaugauuucaccugaccugaagaucgauaaagugaucgacaagggaauuagggagauacuucggacucgacucgccaaauucaacggcgaugcucagaaggccuuuagcaaccuggacgaaaauccaaucuauaaagacgaggcaaagaagauuacauugaaaagagucagucuggaagguguuucuuccgugaucccguuacauaagcucaaagauaugggcgggaagcccgugguaggaaaagacggcaagccugucuggggagauuacgugcagaccagcaacaaucaccacauugcuuucuacauggacgagaacgggaaucugcaagaugacguugugacauuuuucaaagccgcacgcaggaagucgcagggcgucccagugaucgauaagaacuauaaucaugacaaagguuggcacuuucuuuucacuaugaagcagaacgaauacuuuguuuuccccaaugaggccaccggguucauaccuacggagguggaucugauggacgaagcuaacuaugauaugaucucaccaaauuuguaccguguacagaaaaugucuaagaccaaacaaggaauuacagacaagcgggauuauugguuuagacaucaccucgagacuguccugaacaaugaccuaaaggugaggaacaguaucuucaaacagauuaauucccugaagccccuugaaggcaucgugaaaguccgcauaaacgcgauugguaagaucguugccaucggcgaguacgacuga

SEQ ID NO: 3206 - RNA, 4143 nt, Artificial Sequence
  Cas9 variant
augaagagaauccugggccucgaccuugggaccacaagcauuggaugggcccuggugaacgaggcugaauccaauaacgaggcaucuucaauagucagguuggguguucgggugaaucccuuaacuguagaugaaaagaguaacuucgagaagggcaaagccaucacgaccaaugcggaccgccagcugcgacacggggcucguauuaaccuacaaagauacaagcucaggcggcagaaucugcaugauugccuucagaaacagggauggcugggcacagaagccauguaugaggaggguaaggcaagcacuuuugaaaccuacaaguugcgcgccaaagcugcagaggaagagaucucccuccacgaguucgccagagugcuguuuaugcugaacaagaaaaggggguauaagucuaaucggaaagcuaacaauaaggaagacggacaacucuucgauggcaugacaauugccaagaaauuauacgaggaacaucugaccccugcggaguauucgcuucaguugcugaacaagggcaaaaaguuuacucagggguacuaucgcucagaccuaaaugcagaacucgagcgaaucugggaugagcagaaaaaguacuacccagaaauacugacagacgaguucaaacaacagcuugaaggaaagaccaagacgaacacuagcaaaaucuuucuggccaaguaugguauuuacagugcugauuugaaaggccucgacagaaagcugcagccguuaaaauggagggucgaggcccugaagcagcaaguggauaaggaaguucucgcauucgugaucuccgaccuuaaagggcagauugcuaauaccucuggacuguugggcgccaucagcgaucgguccaaggagcuauauuuuaacaaacagacagucggucaauaccugugggcgucacucgaggaaaacccccacauaaguauuaagaauaaaccuuucuaucgucaggacuaccuggacgaguuugaaaagaucugggagacucaggccaccuuccauaagcagcuuacaccagaacugaaacaagagauucgcgauaucaucauauuuuaucagagaccccucaagagcaaaaagucuuugauuuccgugugugagcuggaacagaggaaaguaaaggcaaccaucgacgggaaggagaaagaaauuacgaucggaccuaagguugcuccaaaaucaagccccguguuccaggaguuccggauauggcaaaacuuaaauaacguccugcuaauugauaaugacacuaacgagaagcgaccucucgaugaagacgagcgcuaccugcuuuacaaagaauugaguaucaaggccaaacugucuaagacagaggcucucaagauccugaauaaaaagggcaaacagugggaucuuaacuauaaggaacuggagggcaauagaacccaggccauuuuguuugacugcuacaacaggaucauuacucucacagggcacgaggaaugugauuucaaaaagauaaaggcauccgagauccggcacuaugugagcaccauuuuuaaaaaucugggauucucgacggaaaucuuagacuuugauccaucucuggagaagcaugaacuagagaaacagccgauguaccaacucuggcaucugcuuuauuccuacgagucagacaacagucgcaccgguaaugagagcuugcugagaaagcucgaaacaacuuucggcuuucccgaagaguaugccaccgugcugugcgacgucguuuucgaagaggauuacgggaacuuauccgugaaagcuaugaggaagauccugccuuaccuucaggcgggaaaugacuauucucaggcaugugccuacgcuggcuauaaccacagccgucacucauugacaaaggaggaacucgaucagaaaguauacaaggagcggcuggaacuacugcccaaaaacagucuccgaaaucccguggucgagaagauucugaaccaaaugauaaaugugaucaacgccauuaucgacgaguaugguaaaccugaugaaauuagaaucgagauggcaagggaacuuaaguccagcgccgcugaccgcaagaaaacuacccacgccauaaaucaggggaacgaugagaaucagugcauccgggaaauuuuggagaaggaguuugcacugucuuacaucucaagaaacgacauuaucaaauauaaguuauacgaggaacucaaaccaaauggcuucaagacacuguacagugauaccuauauacccaaagacaaacuuuuuagcaaggauuucgacauugaacauaucauuccgaaagcgaggcuguuugaugacuccuacucuaacaagacuuuggaggcucgcgacaucaaucucgccaaaucgaacaagacggcauucgauuucguuaaagaaaaguauggagagcaaggcgccgaggcuuacaagaaaaagcuggacaugcuacuggggaauaacgugauaagcaaaccuaaguauaauaaacuccugaugacagaagccgauauccccuccgacuuuauuaaccgagaucuucggaacacccaguacaucgcacguaaggcuugugagauuuugggagaacuggucagaacugugaccccaacaaccgguaagaucacuaauagguuacgcgaggacuggcagcucguagauguuaugaaagaacugaacuucgagaaguaugagaaacuuggccugacagaaauaguggaggaccgggaugggagaaagauuaaaaggaucaaggacuggacgaagcgaaaugaucaccgccaucacgccauggacgcgcuagccaucgcuuuuaccaaaccuucauacauucaguaccucaacaaucugaacgcacggaguaauaagggagauucuaucuaugccauugaaaacaaagaguugcauuacgaggaaggcaagcugagauucaaugcucccauaccagucaacguguuuagggccgaggcaaaacgucacuuaagcgcgauccucgucuccauuaaggccaagaauaaagugaugacucaaaacguuaauaagaucaaaacaaagcacgguauuaucaaaaagauacagcugaccccacgcgggccucuucauaacgaaacaaucuauggcacuaaaaugcggccaauuaucaagaaggugaaaguaggagcugcccuggacgaggcaaccauuaauaaggucucaagcccggcuaucagagaaguguugcucaaaaggcugaacgaguacucuggcaacgccaagaaagcauucacggggaagaauacccuagacaagaaccccauauaucugaaugccgagcgaacaaaaacuguuccugcuuccgugaagaccgucgaaugggagaacuaccacccaauucggaaacccaucacaccugaucuuaagguggacaaaguaaucgauaagggaauuggugaaauacucaaggcgcgccuggaggaauuuaauggcgacgccaaaaaggcauucaguaacuuggaggagaauccaaucuaucuggaucagacuaaaaagauugcuuuaaaaagagugagcaucgaagggguucucucuaccauuccccugcauacgcuuaagaaccaggccggaaagccgaucaugggcaaagacgguaagccuguccuggggaauuacgugcaaacauccaacaaucaccacauagccuuuuacuaugaugaggacggcaacuugcaggauaaugcugugucauucuuugaagcagccgagaggaaaagucagggaaucagcgucauugacaaggauuacaaccgggacaaaggcuggcgauuccucuuuaccaugaagcagaaugaauauuucguuuucccaaacgaggcgacuggguuuauccccucggagguggaccugacagaugaagcuaauuacggaauuaucuccccuaaccuauauagagugcaaaagaugucucgcauagagaagggcaccagcguaucaagggacuacugguuccgucaucaccuggaaacuauucuuaacgaugacagucggcucaaaaauuccgccuuuaaaagaaucaacucucugaagcccuuggaggguaucauuaaagucaggaucaauagcauagggaagauuguggcaguuggagaguaugauuga

SEQ ID NO: 3207 - RNA, 4143 nt, Artificial Sequence
  Cas9 variant
augaagaaaggcuacagcaucgggcuggacauuggaaccaacuccguggguuucgccgucauaacagaugacuauaagguucccucuaaaaagaugaaagugcucggcaauacugauaagagauuuaucaagaaaaaccuuauuggggcucuguuguucgacgagggaacgaccgcagaagccaggcgguuaaagcgcacagcgcgacguagauacacuaggcggaaaaaucgccugagauaucuacaggagaucuuuucagaagagaugaguaagguagauagcuccuucuuucacaggcucgacgauucuuuccugauuccugaagacaaacgggagucgaaguacccaaucuuugcuacccuugaggaagagaaggaauaucauaaaaaguucccgacaauauaccaucugcgcaaacauuuggccgauucaaaggagaaagcagaccuccgacugaucuaucuggcccucgcucacaugauuaaguacagaggccacuuuuuauacgaggauaccuucgacaucaaaaacaaugauauucaaaagaucuuuaacgaguucauaagcauuuaugacaaugcauuugaagguaguucccugucugggcagaacgcccagguggaagcuaucuucacugacaagauuagcaaauccgccaagagggagcggguccuuaaauuguuccccgaugaaaagucaacaggacuguuuagugaguuccuaaaacucaucgugggcaaucaggcggacuuuaagaagcacuucgaucuggaggacaaagcaccucuucaauuuagcaaggauaccuacgacgaagaucuggagaacuugcucggccagaucggggacgauuucgccgaccuguuuguugcugccaaaaaguuauaugaugcaauucugcucucuggaauacuuacggugacugacccauccaccaaagcuccccugucagccagcaugaucgaacguuacgagaaucaccagaacgacuuggucgugcuaaagcaguucauuaagaauaaccugccugaaaauuauguagagguuuuuagugaugacucuaaaaacgguuacgcgggcuaugugggggucgauuccaagauccgcaaaagaaacgccaagcucgcaacagaggaagaguucuacaaauaccugaagaauauacuuaacaaugugaagggagcugacuauuuucuggauaaaauugaaagggaggacuucuugcggaagcaacgaacuuuugauaacggcagcaucccacaucagauccaccuccaggaaaugaaugccauucugcgcagacagggugagcauuaccccuucuuaaaagagaacagggaaaagaucgagaaaauucugaccuuccggauaccuuauuacguggggccacuagcucgcggaaauagagacuuugccuggcucacaaggaacucggaucaagcaauccguccguggaauuucgaagagauugucgacaaggccucuuccgcugaggauuuuaucaacaaaaugaccaauuaugaccuguaccuucccgaagagaagguuuugccuaagcacucacugcucuaugaaaaauucgcgguguacaacgagcugacgaagguaaaauuuaucgcagaaggccuucgggauuaccaguuccuggacaguggccagaagaaacaaauugugaaucaguuguuuaaggagaagcgaaaagucacugagaaggacauaauccacuaucuccauacaguggauggguacgacggaauugaacugaaagguaucgagaagcaguucaacgccagcuuauccaccuaucacgaucugcuaaaaauuaucaaggacaaggaauuuauggaugacccaaagaaugaggaaauacucgagaacaucguucauacucugacaauuuucgaggauagagaaaugaucaagcagaggcuugcucaauacgacucuuuguuugaugagaaagugauuaagagccugacccgccggcacuauacgggcugggggaaacucucagccaugcugaucaacggaauaagagacaagcagaccggcaagacaauuuuagauuaccugaucgacgaugcauauuacaauaggaacuucaugcagcuuauuaaugacgacgguuugaguuuuaaagaaaucauacagaaggcccaagucguggggaaaacugaugacguaaagcagguugugcaggagcuccccggcuccccugcuaucaaaaaggggauucugcagagcaucaaaauugucgaugagcuagugaagaucaugcgccauaacccagaaucuauagucauugagauggcccgagaaaaucaaaccacagcacggggcaagaaaaacucacagcagcguuacaagagaaucgaggacgcgcugaaaaaucucgcucccgggcuggauaguaacauccuuaaggaacacccgacugacaaugugcaguugcaaaacgauaggcuguucuuauauuaccuccagaauggaaaagacauguauaccggugaggcccuggauauuaaccagcuuagcuccuacgacaucgaucacauuauaccucaagcauucaucaaggacgacucuuuugauaaucgcguucugacaucgagcaaggacaaccggggcaaauccgauaaugugcccucaauugagguaguccagaagagaaaagccuucuggcagcaguugcucgacaguaagcugaucucugaaaggaaauuuaacaaccuaaccaaggcugagcgagggggacuggaugaacgcgacaaggugggcuucauuaaacggcaacucguugagacuagacagaucacgaagcauguggcccagauacuggaugcaagguauaauacagaagucaacgagaaagacaagaaaaaucguaccgugaagaucauuacucuuaagagcaacuugguauccaauuuucgcaaagaguuccggcuguacaaggugagagaaaucaacgauuaucaccaugcucacgacgccuacuuaaaugcgguugucgccaaagcuauucucaagaaauacccaaagcuggagccugaauuuguguauggugaguaccagaaguaugaucuuaaaagguacaucucacgaagcaaggaccccaaagaaguggagaaggcaaccgagaaauauuucuuuuacucuaaccugcuaaauuucuuuaaggaagagguccacuaugccgaugggacaauaguuaaacgggaaaacauugaguacuccaaggacaccggcgaaaucgcuuggaauaaggagaaagacuucgccaucauuaagaaagugcucagucugccacaagugaacauaguaaagaaacgcgagguccagacuggaggcuucagcaaggaaucuaucuugcccaagggaaauuccgauaaacugauuccuagaaagacaaaagacaucuuaugggauacgaccaaguacggagguuuugacucaccagugauugcauauaguauccuccugauagcggauaucgagaaaggcaaggccaagaaacuuaagacuguuaaaacacugguggggauuaccaucauggaaaaggcugccuucgaggacaacccgauuacauuuuuggagaauaaaggauaccauaacgucaggaaggaaaacauccucugccugcccaaguauagccuauucgagcuggaaaauggccggcgaagacuucucgcaucggcuaaagagcugcagaaggguaacgaaauaguguugccuguuuaccugacuaccuuacucuaucacuccaaaaaugugcauaagcuggaugagccagggcaccuugaguacauucagaaacaucgcaacgaauuuaaggaccuguugaaucucguaucugaguucagccaaaaauauguccuggccgaugcaaaccuagaaaagaucaagucacuguacgccgacaaugagcaggcugauaucgaaauucuugcgaacaguuuuaucaaucuccugacguucaccgccuugggcgcacccgcugccuuuaaauucuuuggaaaggacauagauaggaaacguuacacaacuguguccgagauuuuaaacgccacccugauccaccagucuauuacaggccucuaugagacucggaucgaccugagcaaacuuggggaagacuga

SEQ ID NO: 3208 - RNA, 4143 nt, Artificial Sequence
  Cas9 variant
augaaccugagacacgugggcaauuacaacaucgggcucgacaugggaaccgccagcgucgguugggcugcaauugaugagcagggcgaacuucugcauuucaaggggaaacccacauggggauccagguuguuugacucugccaauacugcggcuacggcccggaugccucgcggccaacgacguagauauauaaggcggcgcuggagauuagaucugcuacagaaguucuuuucagaggaaauggcagagaaagacccagaguucuuuaucaggcuccggcagaguagccuguggccggaagaucgcgagggugggcacaccgccuaccauuggccccuuuucaacgacuccgauuuuaaugaaaaggaguauuacgaaaaauucccuacaauuuuucaucugcgacagugguugauggagacugacgagaaggcugauaucagacucauuuaucuggcauuccacaacaucguuaagcacaggggaaauuuucugcaagaaaacaaugacucucucucggcccagaacgcuaauaugcgggagucauuagagagcuucugcauagcccuggaagaauggugugaugagaaagagcuuaccugcaguugugacccacagaaguuggaacaccuguuuaaagaggugaaguaccguuccgauauccgcgacggcuucgcggcacuacucggccuggccugcucuggggaaaacgagguagacgugaaagcuauggccaaggaaaugggaaaggcaauugucgguuauaaagcugauuucagcaagaucuuuacagagugugacaaagagggcuccucauucagacuuagugaugacgaagggcccgaggccuuucuggauauuugcccugacgauggaaucgcguuguucgaagccauacagaugguguacagcucuuuuauucucaccggcaugcugacugagaaggguuuaucccugucaaaaaucagcgcauacaaucaauaugggcaggaccucgaaagucuuaaggcucugguuaaagaguacgugccaaacgaguauucuuccuucuuuaggggacccacauacagcggcucgaccgaauaugauccuucuaaggcccagggcuacacgcgguauaauuuggggccauccaagaaaggaucaggugcuaagccgauggccuacgaggacuucaaaaagagugucgaacagcuauuugcaaacacuaacgccauuaaugaugagcgauacaaagagaugaugggccgcuucgcugaagagaaguuucugagaaggcuccggaccagcgacaacgggcgcauccccuuccaacugaaucuugaagagaugacagcgaucauuauaaaccagggaaaguauuacccuuuucuguuggaacagcaagagaaacucgagucccuggugagauucaggaucccauauuacguaggccccuuaacucguauuaaugcacggcuggacucuaaggguaacgccuguuucgcuuggagcaaacgaaaggaugggauggacucagccaguaucaaaccuuggaauugggaugaaguuauagacaagcaugcauccgcccaggcuuuuauugagagaaugaccggcacaugcaccuaucuaaggggagaaccagugcucccccgcuguagccugcuuuacgaggaauauugcgucuugaacgagcugaauggcgcccgguggacgcaggauggggacaaguucaucagauuugauuacaaagacaggucugauaucauugaggaacucuucaagaaacgccgaggacggauccaguacgcagcgguggcugacuggaugaagcaagagcguucacacgccaacgugcaugucagugguggccagggggaaaaugcauuugagagcagacuguccucuuaucacuucuuuuguaacgauguuuucggaguggacgaacuuccgggcucguacguagauaugguggaggagauuauacuguggagcacuuuguuugaagacagguccauccuccgcgaggaaauucagcggaaauauggugacguccugaaugaggagcagaucaagacaaucugcaagaaaagauucucaggguggggcagguuaagucgaaagcugcuaugcucucucaaagcccaaaccgauaacggaccuaagagcauuauggacauacugcaggaaggcgaucagaauaacgggcgcgugggacgggcuaugguuuuucaggagauccuucacgacgaacaauuggguuucgagcagaaaauugaagaggagaacacucaguccaugcuggaaggcgagaaucuccugaucgaagauuuacccgggucaccagccauuagaaggagcaucaaccaggcagugcguauagucgacgagaucgugggaauugcuggccaugccccugauaauaucuuuauugaaguaacacgcgaggacgauaccaagaaaaaggguaagcggacgaccacaagauacucuaacauccaaaaagcgcuggaggcccuuaaggaagagggggcugaagcauugagggagcucaaaacuuauaagcacaaugaacuggacaaacgacuaucccuguacuucaugcagaacggcaagagucucuauagcggaauaccccuggauauucggcgccuuucugaguaccagaucgaccauauuaucccacaauccuacauaaaggaugacucauaugagaauauggccuugguucugcccggcgaaaaccagaguaaagcugacaauuuacucaucagccaggauauuagaaucaagaugaaagccaccuggacagcacugcacaaggcggggcuuaugggagacaaaaaguacaacaaucugaugaacucguccauuucugaugccaagaugaaaggcuucaucaauaggcaguugguggagacuagccaaucagucaagcucacccagaugaugcugagucagaaauauccuggugcuaaggugcggccaauaaaagccuccauuucuagccagcuacgagacgcaugugaucuggucaagugcagagaagcuaacgacuaccaucacgcccacgaugcauaucucgccugucaaguggggcgcuuuguucugaagaggcauuccucaauguucgacaauccgaucggaaugacaaaagugauccgugauuuuguaaagcggcagggccaggaguucaaaagaaacgguaaacuucccgcuuacgcgagcaggaguggcuuuauuguccagucuuucaugcgcuccggguuugacgccgagaccggagaauugcugcgagaugacuggaacgcaccuuucgagaucgcuagaauuaaacggugcuuaaauuauagggacuguuacauaagccgcaugccaauggaagauucgggcgccuuuugggacgccacuaucuacucacccaaggcugggaaaaagggagcacucccugugaagcaaggccugccaguugagaaauaugguucuuacagucgugaacaguucgccuacuuuuucguguauaaggcguauaaccccaaaaagaaggcuuacagacuugaguucgaggccgucccggugcggguagcauccgccguggaaacgagggagaaugcucuggaagaguaugcaaagagcguugccaagcaggcggggcuagaauuugucgagguggcucgcccuaaaguguacaaguaccaacucauugagcugggagaagaucgauuguauaucacaggcaaaagagagguccggaacgccucucagcuggcauucagcuuagacgaaauugaucuccugaagaggcuugccgagggugaagagaccuccucagaggaacgcgagagacuguuugacguuuugaucgaaaaauacgcuagguaugccccacggcucgcacgucagcugaguguggauagcaugucugcuacuuucgagacccuaaaugccgaggaacagcugggcauacuucucucccugguggagaucgcgaacgggaagcgcaauaugauugacuugucaagugccggaggcagcaagaacgcagggugcaugaaucccacauuuuccucugaacugucgagcccuggaucaaacuucaccuuuaucgaucaauccguaacuggcauguucgagcgaagacagagguuagaacucuga

SEQ ID NO: 3209 - RNA, 4146 nt, Artificial Sequence
  Cas9 variant
auggugaagaaaaaguacgccaucggcauugacauagggaccaacagcgucggaugguccaucguuacagaugacuauaaagugcccucuaagaaaaugaagguauucgguaauacugagaagagauacauuaaaaagaaccugcucggcacgcuucuguuugaugaagggaauaccgcugagaacaggcgguugaaacgcacagcacgacguagauauacuaggcggcgcaauagaaucuuauaccugcaggaaauuuucgccgaggaaaucaacaagauagacgauucauuuuuccaaaggcuagacgauaguuuucucaucguggaggacaaacagggaagcaagcacccuauuuucggcacccugcaggaggaaaaggaguaucauaaacaguuuccaacaaucuaccaccuucggaagcaacuggcggauuccucucagaaagcugacauucgcuugaucuaucucgcccuggcacauauaauuaaguaccgaggucacuuccuguuugaaggggaucucaaaucggagaauaaggacguccagcauuuauucaacgauuuuguggagauguucgacaaaaccguugaaggaucauaccugagcgagaaucuuccgaacguggccgacgucuugguggaaaagguaaguaaguccagaaggcuggagaauauccuacacuauuuucccaacgaaaagaagaauggccucuucggcaacuuccuggcucuugcacugggguugcagccuaauuuuaaaacuaacuucgagcucgccgaggaugcuaagauucaauuuucuaaagaaacauacgaggaagaccuggaggaauuacugggaaagaucggugaugacuaugccgaucucuucaucgcgaccaagagccuuuacgacggcauucuguuggcagggauacuauccacgacugauucaaccacaaaagccccacugaguagcucuaugguuaaccgguaugaggagcaccagaaggaccucgcucugcuuaaaaauuuuauccaucagaaccuguccgauucauacaaggaaguguucaaugacaaauugaaggauggauaugccggcuacauugaggguaagacuacccaggaaaacuuuuaccguuucaucaaaaaggcaauagagaaaauugaagggagcaauuauuuuaucgacaagaucgaccgcgaggauuuccucagaaaacaaaggacauuugacaacggaaguauuccccaccagauccaucugcaggagaugcacgcuauuauacggcgacaagccgaguucuacccauuuuuagucgagaaucaggauaagaucgaaaagauucugaccuuccgcaucccuuauuacgugggcccccuagcgagaggcaaaucugaguucgccuggcucaacaggaaguccgacgagaaaauccggccuuggaauuuugaugaaaugguggacaaggagacgagcgcagaaaacuucauuacucgcaugacaaauuaugauagauaccugccagaccagaaaguccuuccgaagcacucguugcuguaugagaaauuugcuguuuacaacgaacucaccaaggugaaguucauagccgaggggaugagggauuaccaguuucuggacucuggacagaaaaaggauaucguaaaaacucuuuucaagacaaaacguaaggugaccgcuaaggacauuaaagccuaucuggaaaauuccaacgguuacgcaggcgucgaauugaaggggcucgaggaacaauuuaaugccucacugcccacguaucaugauuuacugaaaauccuacgggacaaggcuuucauugacgcggaggaaaaccaggagauccucgaggauauagugcugacccuuacauuguuugaagaccgagagaugaucagaaaaaggcuggaaaaguacaaggauauucucacugaggaacagcgcaaaaagcuggagcggagacacuauaccggauggggcagguuaagugcaaaacugaucaacgguauucuugacaagguuacacgcaaaacuaucuugggguaccucauagaugacggcaccagcaaucgaaacuucaugcaacugauuaaugaugacacacuauccuuuguggaugagauccggcuggcccagggaucuggcgaagcugaggacuaucgugccgaaguccagaaccucgcagggagcccugccauuaagaagggaauccugcagucacuuaaaauaguggaugaguugaucgagguaauggguuacgaaccagagcauauuguuguggaaauggcuagagagaaucaauucaccaaccagggcaggcgcaauagucagcagcggaucaacagacuggaaaaugccuuaaaggacuuuggguccaaaauucucgaggagcaaaagcccuacggagucagcaaagugaacaauauccaucugcagucugauaggcuuuuccuguauuacuugcagaacggcaaggacauguauacugacgaggaacucgauauagaccaccugucagaauacgauauugaccacaucaucccucaagcauucauuaaagaugacagucuagauaauaagguccugacaaagagcgcgaaaaaccgagguaaguccgacgaugugccaucuauggagaucguucacaaucgcaaaaacuuuuggcggcagcuccugaagucgaaacuuauuagccagagaaaguucgacaacuugacgaaggcugaacgagggggccugaccaaugaggauaaagcccguuuuauacagcgccaauuaguggagacucggcagaucaccaagcauguagcaagaaugcucgacacaagguucaacaccaaacuggacgaagccggaaauaggauucgggaucccaaggucaacaucauuacucuuaaauccaaucuggugucacaguuucgcaaggacuaucagcuauacaagaucagagagauaaacaauuaucaccaugcucacgaugccuacaucaacgcaguuguggcuacagcccuccugaaaaaguacccgcaauuggcgccugaguucgucuauggcgaauaccccacguauaauaguuacaacucuaggaaaagcgccaccgaaaaggugcuguuuuauuccaauauuaugaacuucuuuaaacggaucguagugcacucaaagacuggggagguucgaauuagaccagucaucgaggugaauaaggaaacaggagagauagugugggacaaaaagagcgauuuccgcaccgucaggaaaguuuuaucuuacccucaggugaacgugguaaagaaaacagaaguccagaaucauggucucgaccguggcaagcccaagggguuuuauaacgcuaaccuguccccacggcccaaagagggaaguguggagaaucuuguuccugcaaagcagagcuucgauacuaaaagauacggcgguuacgccgggauuucuaacuccuaugcugugcuggucaauggcaucaucgaaaagggcaaaaagaaaucaaaggccgaggugaccgaguuccaaggaauuaguauauuggcaaggaaggacuuugauaaaaacccaaagcaguaccuccugaaucuaggguauaaagacaucaagagcauuaucaaacugccgaaguacucgcuuuucgaacucgaaaacggaucccgccgaaugcuggcgucuauuuugagcacgaauaacaagagaggcgagauccacaaagguaaugagauguaucugcccgauaaguuuguuaccuuacucuaccaugccaugcgggugaacaggacacuggaaccugggcacaaaaaguauguagagacucaucgccacgucuucgacgaacuucugauauacaucuuggaguacaaugagaaaauugugggagcuaaggccaacggcaagcguaucguggaagcauauucagcuagaaaagauaccgacaaucucgaggaacugugcaacaguuuuauuaaucuacugaaccuuacagcccucgguuccgcagucgacuucgaguuucugggcacuaagaucccacgguacagggauuauacccccucuagcuuguuaaaagccacgcugauacaccaguccguuacagggcucuacgaaacccgcauugaccugucaaaacuuggaggcgauuga

SEQ ID NO: 3210 - RNA, 4146 nt, Artificial Sequence
  Cas9 variant
augaacuacgugaaggaguaucacaucggccuggacauugggaccagcuccauaggaugggccgucacagauucucaguucaaacucaugagaaucaaggguaaaacugcuauuggcguuaggcuuuuugaagaggggaagacggcagccgaacggcgcaccuuccgaacaacucguagaaggcugaaacggcgcaaguggagauugcauuacuuagacgagaucuuugcgccccaucugcaagaaguggaugagaauuuccuaaggcggcucaagcagucaaacauucacccugaggacccagcuaaaaaucaggccuuuaucggaaagcugcuuuucccggaucuguugaaaaagaacgaacgcggcuaucccacccucauaaaaaugcgagacgagcugccuguagaacagagagcacacuacccagugacaaauaucuauaagcugagggaggccaugauuaacgaggaucggcaauuugaccuccgugaagucuacuuagcugugcaucacaucguuaaguaucgcggucacuuccugaauaacgcaaguguggauaaauuuaaggucgggagaauugacuucgauaaaaguuuuaaugugcuuaacgaggccuacgaagaguugcagaauggagaaggcuccuucaccaucgagcccucuaagguagagaaaauaggccagcugcuacucgacacuaagaugaggaaacuggaucggcagaaggcuguugccaaguuucuugaagugaaagucgcggacaaggaggaaacaaaacgaaacaagcaaauugcaaccgccaucucgaaacugguguugggguacaaggcugacuucgccacgguggcaauggcuaauggaaacgaguggaagauugaucucucaagcgaaacuagcgaggacgagaucgaaaaauuccgcgaggaacuguccgaugcccagaaugacaucuuaaccgagauuacaucucuguuuagccagauaaugcucaacgaaaucgucccuaacgguauguccauuucagagaguaugauggauagauauuggacucaugagaggcagcuugcggaaguuaaggaguaccuggccacccaaccagcaagcgcucggaaagaguucgaccagguguauaauaaguacaucggccaggcccccaaagaaaagggguuugauuuggagaagggacucaaaaagauacugucuaaaaaggaaaacuggaaagagauugacgaacuccugaaggcuggcgauuuccuuccuaagcaacgcacauccgccaauguagugaucccacaccagaugcaucagcaggagcuggacagaaucauugaaaaacaagcaaaguauuacccgugguuggccaccgagaaccccgcuacgggugagagggaucgucaccaggcgaaauaugaacucgaccagcuggucucauuucggaucccuuacuacguggggccauuaguuacucccgaggugcagaaggcaacaagcggagccaaauucgcuugggccaagcgaaaagaagacggcgagauuaccccuuggaaucugugggauaagauagacagagcagaaagugccgaggcuuuuaucaagaggaugacugucaaagauacauaucuacucaacgaggacgugcugccagccaauucucuuuuguaccaaaaguauaacguacugaaugaacucaacaauguucgcgugaacggccggagacuguccgucgggauuaaacaggauaucuacagcgagcuuuucaagaaaaagaagaccgugaaagcaucggacgucgcgucucuggugauggcuaagacgaggggaguuaauaaacccuccguggaagguuugucagauccgaagaaauuuaacaguaaucucgccaccuaucuggacuuaaagagcaucguaggcgauaaggucgacgauaacugcuaccagacagaccuggagaacauuauagaauggcgcuccguguucgaggauggggagaucuuugcagacaaacuaacugaaguugaguggcucaccgacgaacagcgaucugcccuggugaagaaacgguauaagggauggggccgucuuagcaaaaaguugcugacagguauugucgaugagaaugggcaaagaaucauugaccucauguggaacacugaucagaauuucaugcagaucgugaaccagccuguauuuaaggagcaaauagaccagcugaaucagaacgcuaucaccaaugauggcaugacauuaagggaacgcguggagucaguucuggacgaugccuacaccaguccccaaaacaaaaaggcaauuuggcaggucgugcggguggucgaagacaucguuaaagcugugggaaaugccccaaaguccauuagcaucgaguucgcgagaaacgaaggcaauaaaggggagauaacuaggucucgacgcacgcagcuucagaaguuguucgaggaucaagcccacgaacucgugaaagacacaucacugaccgaggaacuagagaaggcucuggaucucagugaccgguacuaucuguacuuuacucagggagguaaggauauguauaccggcgacccuauuaacuucgacgaaaucagcacaaaauacgauauugaccauauccuuccccaguccuuuguaaaggaugacucuuuggauaauagaguccuggugucgagggcagagaacaauaaaaagagcgaccguguuccagccaaauuauaugcugccaagaugaagcccuacuggaaccagcuccugaaacaagggcuuauaacccagcgcaaguucgagaaccugacuauggauguggaccagaauaucaaauaucgguccuugggauuugucaagagacagcucguggaaacaaggcaaguuauuaaacugacggcaaacauccuaggcucaauguaccaggaggcggguaccgauauuaucgaaacucgagccgggcugacaaagcagcuccgggaggaguucgaccugccuaaggugcgcgaaguaaaugauuaccaccaugcugucgacgccuaucuuaccacauuugcaggccaauacuugaacagaagguauccaaaacugcggaguuucuuuguguacggagaguauaugaaguucaaacgaggcucugacuuaaagcucagaaauuuuaacuucuuucacgaacugauggagggggauaaaagccagggaaagguggucgaccagcagacuggugaacuuauaaccacgcgcgaugagguugcuaaguccuucgacaggcugcuaaauaugaaauacaugcucgugucaaaggagguacaugaucguagcgaccaacuguauggcgccaccauugugacagcaaaagaaucugggaaguugacuuccccgaucgagaucaaaaagaaccggcccgucgaucuguacggagccuacaccaauggcacaagugcuuucaugacuauuaucaaguuuaccgguaacaaaccuaaguauaaagugauugggguuccaacgacaagcgcggugggcuuaaagagagucggaaaacccggcucugaauccuacaaucaggagcuccacaggauaaucaagucaaacccuaaagugaagaaggacuucgaaauuguugugccacacgucaguuauagccagcugaucguagauggggacuguaaauuuacccuugccucggauacuuaccagcaucccgcaacacaacugguguuguccaaggagucuauggagauuaucgcugacgauuucaaauuuguuaaggaaaauccggccaccgccgacgagcagcucgugcgcgucuucgacgaaauagugaaccagaugaaucacuauuuuacuaucuucgaucagcgaagcaacagacaaaaaguaaccaaggcucgggacaaguuugugucacugccuacagagagugaauacgagggagccaaaaagacgcaggucggcaaaaccgagguuauuacuaaccuacugaugggucuucaugcaaaugcggcucagggggaucucaaggugcugggauuguccacauucggcuuuuuccagucuagcgguggccugaacuuauccgaagacgccaugaucguguaucaaucaccaaccgggcuauucgagaggcgcauuugccugaaagauaucuga

SEQ ID NO: 3211 - RNA, 4146 nt, Artificial Sequence
  Cas9 variant
augaagcagauccugaaaaaggugcaaggcuacaacauugggcucgacauaggaaccaauagcgucgguuggguugugacagaugagaacgccaaucuucugcaguucaggaaaaagaacauguggggcgcuagauuguuugaaaaaggggacacugcacagggacggcgcuuaucccgaucuacgcguagaagguaugaucggcgcagacagaggauccacuaccugcaagagaugcuagccaccaugguacuccccauugacgaaucauucuuuauccggcugaaugaggcguuccuuuggaaggaagauaagagugugcagcgcgacuauauucuguuugcugauaaacaguucacagaccgagauuuuuacaagcaguucaaaacuaucuaucauuugagaaaguuucuccuggacaccaaagagaaggccgauccuagguucauauaccuggcacuccaccauaugaucaaguaucggggcaacuuuuuauaccaaggucagagcuucgacgucguggagaauguucaggaauccuuucgugugcugcuugaggaaauguacgagcaguuggggaaagagugggaauauggagagcacuucgaugacauucaacgcauccuggaaaacacaaccauuggcaagaaaucuaagcaggagcagaucgccgcuauacuaacugaacaauacggcaauaaaaagcucgcaaacgaggucacaagagccugccugggguauucguucgaccuuaccgugguaauggagaaugaaaaccuguuggaugagucaggaaagaagauuaagaucagcuuuagugacuccaaauacgaagaacaggaacucgagcugcagaauagguuagaggaaaaguucgcuguuauugaggcccugaaacggaucuauaacuggcucgugcuuaaggauacgcugcgagguaaaaaguacaucucugaagcgauggucaauaaguaugaggcacaucacgaagacuuggugaaacuaaagcgccuguuuagaacuuaccucagcaccgaggaguacuccuguuucuuuaggaaagaaaagcagaaagauaaguauauuucaaacuacgugaacuaucggaagggcgccgagcgcugcaguaaagaaaagcuguacaaagcuauacacgagcuuuucgacacagucgccaaggaugacguuguguaucaagagaucguagagaaaauggaucagggggaguuucugacuaagcagaaugaagugagcaacgcauacauuccauaucaguguaaugaggucgaaaugaagagaaucuugaaacaacagggagaguucuacccggagcucaaggaaaacgcugacaaaauacugcaguuacugcuauuuaggauucccuacuaugugggcccucucguugaugagaagcagucuaaauucgccuggaugaagcgucggaccgguauggaacaagugaaaaucuacccauggaauuuugagcaggucguggacaucgaccagacagcggaagccuucauuacccgaaugacgaacuauugcacuuaccugcccgaggagaagguacuuccuaagcaguccuugcuguauucagaauacgagcuccugcaagaacuuaauaaaaucaagauuaacgggaaauuuagccuggagacaagaaauaagauaaucgaacaguuguucaaaaagcagaagaaaguuaccgagaagcaacucaaaaaguggcuggugagggagcaguauuguacuacaaaagucaccgaaaagauggugaaguuagaugagaacgcauacuacauuacgggauuccagaaagaaaaugaguuugcuaguucucugaccuccuauaucgacuucacaaagauccuaggcgagauuacugaacgcaaccggaaaaugauagaggaaaucauuuacuggcucaccgucuuugaggaaaagagcaucgugaaaagaaagauucagaagaaauauggcaaugagaucaacgauaagcaacuggcccagauacuuaaauugaauuacucgggguggggaagguucucugagaaguuucugaacgguaucaaaggcuucgaccgccaggggcagaagaaaacaauuauggaacuccugcgagaggauucccgguuacugaacaucaugcaaauuaucaauaacgaagagaugggauuuugcaagauaauugaagcuaaucagaagaaacuuuauggcaacgagaauuugcucgacguugugcaggagcugcaugguucaccagccaucaagcgugggauuuggcagagucuaaaaaucguagaagagauaaucagcauuaugggcggagucccccaaaacaucuucauugaauuugcaagagaggaugacgauagggugcgcacuaauucccggguuaagcagaucgaaagacuguacaaaaaguucaaggaggaggugaacgacuuuaaugaacacgccgcuaacgagcucaaagaaaagagguaucagaaucgaauagaugaggagaaagucuuccuguacuuuaugcaaaacggcaagucucuuuacagcggggugaccuuggacauugaucgccugaaugaauaugagguagaccauaucaucccucggacauuagugaaagacgauucacucgaaaacaaggcgcugguucuuaagggagagaaucagagaaaaggugaaggccugauuccacacgaguggcagaacaggcagaaggaggucuggaaaaaguugcucaguugugggcugaugggcaaaaagaaguacgcaaaccuaugcaaagaauccuucggaaaugagaaggaacaaaaacacuucaucgcccgucagauuguggagacccgccagauaaucaaacagguggcuaacauucuggcccaauauuaccagggugucaauguugcagccgugaaagcuagccucgggucugaacugcgggagaacuauacuaucgagaagaaggacgauaauggcuuuuucauggaaaacaaaucauacacgaugcuuaagaguagaaaaauuaaugacuuucaucacgcccaggaugcauauuuggcgugugcugugggacuguacaucaaggccgcauucccgaaauacgagaaggaaauagacuaugagggcuacaggaaauauuaccagaagaagaaccaacagaaagaugggguacgaaaugaaaagcggcaguuuuucagcuaugucaugucccgcuuuucugagcagaucguggacaaagagacaggagaaauuuuaugggaugguacccaaaagcucgccuacaucaaaaagauuuucggcuauagagacugccugaucacuaagaaacuugaggaaaacaccggggaguuuuacaagcagacaauaaaugcuaaacccgagaagggaaaagaaaacaauaccaagcugcuaccuauuaagaaaggccucucgguugagaaguacgguggguaucagggcggagaagccgcauacagcugucuggugagguaucaacagggccggaaaacuaaguugucccuggagaaaaucucagucaucauugcuaagaagauagccgaaaaagaggugaguuuagaucgauaccucaaggagaaacuggggguugaagagaucgugauucuuagaaagaaaguaaugaagaaccagcugaucgaagacucugauggaaaucgcuucuauuugacagcggccacggaggucgugaacgcuaaacaguuuauucucgacggcaagcaucaacaucugcuaaggaccaucgcaauaauggaaaagggugaguacuauggguaccgucuggacgagcuugaaaacagcauggaugagcucuacgccuauuaccggaugaaaauccagcagcaguauccagcuuacgaauccauugugaagaaaaucgucgagucacacguuuaugaaagccugcacguggaggagaagauuaaagccguacaagaaaagggaaaguucuugauccagcuguuaagacucacugaggcaaaugcggaaugcauagaccugaaaacaauuucugauggcaggcuugccgaccgcaucggucgaaagaaccacuacaccaucaaagagggcauuaaguucaucgaucaguccauaacagggcuguaugagagauacaugacuguguga

SEQ ID NO: 3212 - RNA, 4146 nt, Artificial Sequence
  Cas9 variant
auggacuacgugaaggaguaucacaucggccuggauauugggaccagcuccauaggaugggccgucacagacucucaguucaaacucaugagaaucaaggguaaaacugcuauuggcguuaggcuuuuugaagaggggaagacggcagccgaacggcgcaccuuccgaacaacucguagaaggcugaaacggcgcaaguggagauugcauuacuuagauaagaucuuugcgccccaucugcaagagguggacgaaaacuuccuaaggcggcucaaacagucaaauauucacccugaggauccagcuaagaaccaggccuuuaucggaaaacugcuuuucccggaccuguugaagaaaaaugagcgcggcuaucccacccucauaaagaugcgagaugaacugccuguagagcagagagcacacuacccagugacaaacaucuauaagcugagggaagccaugauuaaugaggaccggcaauuugaucuccgugaggucuacuuagcugugcaucacaucguuaaauaucgcggucacuuccugaacaaugcaaguguggacaaguuuaaagucgggagaauugauuucgacaagagcuuuaacgugcuuaaugaagccuacgaggaauugcagaacggagagggcuccuucaccaucgaacccucuaaaguagagaagauaggccagcugcuacucgauacuaaaaugaggaagcuggaccggcagaaggcuguugccaaacuucuggaggugaaggucgcggacaaagaagagacaaagcgaaauaaacaaauugcaaccgccaugucgaaguuggugcucggguacaaggcugauuuugccacgguggcaauggcuaacggaaaugaauggaaaaucgaccugucaagcgagacgagugaagaugagauugagaaguuccgcgaagaguuauccgacgcccagaacgauauccugaccgaaaucacaucucucuucagccagauuaugcuuaaugcgauagucccuaacgguauguccaucucagagaguaugauggacagauauuggacucaugaaaggcagcuggccgagguuaaagaguacuuggcaacccaaccagcuagcgcccggaaggaauuugaucagguguauaacaaauacauuggccagguacccaaggagaagggguucgaccuagaaaaaggacugaagaaaauccucucuaagaaagagaauuggaaggagauagaugaacugcuuaaggcuggcgacuuucugccuaaacaacgcacauccgccaacggugugauuccacaccagaugcaucagcaggaguuggauagaaucaucgaaaagcaagcaaaauauuacccguggcucgccaccgagaaucccgcuacgggggaaagggaccgucaccaggcgaaguaugagcuggaccaguuagucucauuccggauuccuuacuacgugggaccacugguuacucccgaggugcagaaagcaacaagcggcgccaaguuugcuugggccaaacgaaaggaagauggcgagaucaccccuuggaaccuaugggacaagauugauagagcagaaagugccgaggcuuucauaaaaaggaugacugucaaggacacauaucuccugaaugaagaugugcuuccagccaacucuuugcuguaccaaaaauauaauguacucaacgagcugaauaacguucgcgugaaugggcggagacuuuccgucggaaucaagcaggacauuuacaccgagcuguuuaaaaagaagaaaacggugaaggcaggcgaugucgcgagcuuggugauggcuaaaaccagggguguuaacaagcccucgguggaagggcucucugacccgaaaaaguucaauuccaaccuggccacauauuuagaucugaagucaaucaugggagacaaaguagaugacaaucgcuaccagauggaucuagagaacaucauugaauggcgaagugucuuugaggacggcgaaauauucgcagacaagcucacugagguggaguggcugaccgaugaacagcggagcgcccuuguuaaaaagcguuauaaagguugggggagauuguccaagaagcugcucacaggcaucguggacgagaacggacaaaggauuaucgaucugauguggaauacugaccagaacuuuaugcagauugucaaucagccuguguucaaagaacaaaucgaucaguuaaaccagaaggcuauaaccaaugacggcaugacacugcgcgagcggguagagucugugcuugaugacgccuacaccagcccccaaaacaaaaaggcaaucuggcagguugucagagugguggaagauauugucaaagcuguugggaaugccccaaagucaaucaguauugaguuugcgaggaacgaaggaaauaaaggugagaucacucgaucccgccggacgcaguugcagaaacucuucgaagaccaagcccacgagcuggugaaggauacaagccuaaccgaggaacuggagaaagcuccugaccucucugauagauacuauuucuacuuuacucagggcgggaaggacauguauaccggagaccccauaaacuucgaugaaauuucaacaaaauacgacaucgaucauauucugccacagaguuuugugaaggacgauagccuugacaauaggguauuggucucccgugcagagaacaauaaaaagucugaucgcgugcccgccaagcuguaugcugccaaaaugaagccuuacuggaaccaguuacucaaacaaggccugaucacccagcggaaguucgaaaaucuuacuauggacguugaucagaacauaaaauauagaucgcuggguuuugugaagaggcaguuggucgagacacgacaagugaucaagcucacggcaaacauucuggggagcauguaccaggaggcgggcaccgacaucauugaaacucgggccggacuaacaaaacagcugcgcgaggaguucgaucucccaaagguuagagaagugaaugacuaccaccaugcuguagacgccuaucugaccacauuugcaggccaauaccuuaacaggcgguauccgaaauugcgauccuucuuugucuacggggaauauaugaaguucaaacacggaucagaucugaaguuaagaaauuuuaacuucuuucaugagcucauggagggugacaagagucagggcaaagugguggaucagcagacuggggaacugaucaccacgcgcgacgaggucgcuaagucuuucgauaggcuucugaauaugaaauacaugcuaguuagcaaggaagugcacgaccguuccgaucaacucuauggagccaccauaguaacagcaaaagagucaggcaagcugacuagccccauugagaucaagaaaaaccggccuguggacuuguacggugccuacaccaaugggacaucugcuuucaugacuaucauuaaguuuaccggcaacaaaccaaaguauaaagucaucggagugcccacgacauccgcgguuggccugaagagaguggggaaaccuggaagugaaagcuacaaucaggaguuacacaggauuauaaagucuaacccaaaggucaaaaaggauuucgaaaucgugguuccccauguguccuauucacagcucauugucgacggcgauugcaaauuuacccuggccagugacacuuaccagcacccggcaacacaacuuguacugagcaaggagucgauggaaaucauugcugaugacuucaaauuugugaaggagaauccugccaccgccgacgagcaguugguucgcguguucgaugaaaucgucaaccagaugaaucauuauuuuacuauauucgaccagcgauccaacagacaaaaggugaccaaagcucgggauaaguuuguaucucucccaacagagagcgaauacgagggugcaaagaagacucagguggggaaaaccgaagucaucacuaaucugcuaaugggacugcacgccaacgcggcucagggcgaccuuaagguucucggucugucaacauucggcuuuuuccagaguuccgggggauugaaccugucugaggaugccaugauuguguaucaaagccccaccggcuuauucgagaggcgcaucugucucaaggacauuuga

SEQ ID NO: 3213 - RNA, 4146 nt, Artificial Sequence
  Cas9 variant
augaagaaaagcuacgccaucggcauugacauagggaccaacuccgugggacacugcgucauguauacagagaauuacaagguucccucuaaaaagaugaaaguguucgguaacacugaaaagagauauaucaagaaaaaucugcucggcacgcuucuguuugaugaggggaacaccgcugaaaauaggcgguugaagcgcacagcacgacguagauacacuaggcggcgcaacagaauuuuauaucugcaggagaucuucgccgaagagauuaauaaaaucgacgauucauuuuuccaaaggcuagacgauaguuuucucauaguagaggacaagcagggaagcaaacauccuaucuucggcacccugcaggaagagaaggaauaccacaagcaguuuccaacaauuuaucaucuucggaaacaacuggcggauuccucucagaaggcugacauccgcuugauuuaccucgcccuggcacacaucauaaaauaccgaggucauuuccuguuugagggggaucucaagucggagaacaaagacgugcagcacuuauucaaugauuuugucgaaauguucgacaagaccguggagggaucauaucugagcgaaaaccuuccgaauguugccgauguguuggucgagaaagugaguaaguccagaaggcuggaaaacauucuacacuacuuucccaaugagaagaaaaacggccucuucggcaauuuccuggcucuugcacugggguugcagccuaacuuuaagacuaacuucgagcucgccgaagacgcuaaaauccaauuuucuaaggagacauaugaagaggaccuggaagaguuacugggaaaaauuggugaugacuacgccgaucucuucaucgcgaccaagagccuuuaugacggcauccuguuggcagggauucuauccacgacugauucaaccacaaaggccccacugaguagcucuaugguaaaucgguacgaggaacaucagaaagaccucgcucugcuuaaggauuuuauacgucagaaccuguccgacucauauaaagaguucuuuaaugauacuuugaaggacggauacgccggcuacaucgaagguaaaaccacacaggagaacuucuaucgcuuuauuaagaaggcaaucgaaaagauagaggggagcaauuacuucauugauaaaaucgacagagaggacuuucucaggaaacaacggaccuucgauaacggaaguaucccccaccagauucaucugcaggaaaugcacgcuaucauucgacgccaagccgaguuuuauccuuucuuaguugaaaaucaggacaagauagagaaaauccugacguucaggauuccauacuaugugggcccccuagcgagaggcaagucugaguuugccuggcucaagcggaaauccgaugaaaagauccgcccuuggaacuucgacgagauggucgauaaagaaacuagcgcagagaauuuuaucacaagaaugaccaacuacgaccaguaucugccagaucagaaggugcuuccgaaacacucguugcuguacgaaaaguucgcuguguacaaugagcucacuaaagucagguauguuacagagcaagggaagucuuucuucuuugacgccaacaugaagcaggaaauuuucgauggaguguuuaaaguauaccguaaggugaccaaagagaagcugauggacuuccuugguaaagaauuugaugaguuccggauagucgaccugaugggcuuggauaaggacaauaaguccuuuaacgcuucacucgggacguaucaugaccugaaaaagaucgugaguaaagauuuacuggacaaucccgaaaacgaggauauucuagagaacguugugcucacccugacacuuuucgaagaccgagagaugaucagaaagagguuggaaaaauacaaggauguccugacugaggaacagcgcaagaaacucgagcggagacacuauaccggauggggcaggcugagcgccaaguuaauuaaugguauccgcaacaaaacaacucgaaagaccauacuggacuaccuuaucgaugacgggacauccaaucggaacuucaugcaguugauucaugaugacacccucucuuuuguggaugagauccgucuggcacaaggcagcggagaagccgaggacuauagaacugaaguacagaaucuagcuggcagcccugcgauuaaaaaggggauccugcagagucucaagauaguugaugagcugauuggagugauggguuacaacccagagcacgucguggucgaaauggcaagggagaaucaguucacgaaccaaggccgccgguccagccagcagagauacaaaaagaucgaaaaugccauuaaaaaccuugacucuaauuugaacucaaagauccugaaagaguaucccacaaauaaccaggcuuuacaaaaugacaggcucuuucuguacuaucuucagaacgggaaggauauguacaccgacgaagaacuggauauagaccaguugagucaauaugauaucgaccauauuaucccucaggccuucauuaaagaugacagccucgauaacaaggugcugacuaaguccgccaaaaaucgaggaaagucugacgauguuccaucgcuagagaucgugcacaaaaagaaaaacuuuuggaagcagcugcucgacagccagcugauaucccaacgcaaguucgacaaucuuaccaaagcagaacggggcgguuugacaaacgaggauaaggcuagauuuauucagaggcagcugguagaaacccgucagaucacuaaacacgucgcccgcaucuuagacacacgguucaauacgaagcucgaugacgcagggaacagaauuagggaucccaaagugaauaucauuacccugaagucaagucuuguuucucaauuucgaaaggacuaccagcuguauaaagugcgggagauaaacaauuaccaucacgcgcaugaugcuuaccuaaacgccgucguggcaacugcccuccugaagaaauauccgcaguuggcuccugaauuuguauacggcgacuaucccaaguacaauagcuauaaaucccgcaagucagccacagagagagugcuguuuuacagcaacaucaugaauuucuucaagaggguugucaaaucuuccaagaccggaacagugaaaauucggccaaucauugaggugaacaaggaaacuggcgagaucgucugggauaaaaagagugacuuucgaaccguuagaaagguguuaagcuauccucaggugaauguagucaaaaagacggaagugcaaaaccacgggcucgaucgcggaaaacccaaggguuucuacaacgcaaaucugucuccaaggcccaaagagggcuccguugaaaaccuugugccugcuaagcagucauuugacaccaaacguuacgggggauaugccggcauaaguaauagcuacgcgguccuggugaacgguaucauugagaaggggaagaaaaagucgaaagccgagguuacagaguuccagggcaucuccauuuuggcucggaaggauuuugagaaaaauccaaagcaauaucuccugaaccuaggauacaaggacaucaaaucuauaauuaagcugccgaaauauagccuuuucgaacucgagaauggcucaagaaggaugcuggcaaguaucuuguccacuaacaauaagcgcggggagauccacaaaggaaacgaaauguaccugcccgacaaguuugugaccuuacucuaucaugccaugcgaguaaauagaacacuggagccuggccacaagaaauacgucgaaacucaucggcacguguucgaugagcuucugaccuacauuuuggaauauaacgagaagauagugggugcuaaagccaaugggaagaggaucgucgaggcauacucugcgcgcaaagacacggauaaccucgaggaacuguguaauagcuuuauuaaccuacugaaucuuacagcccucggauccgcuguugacuucgaauuucugggcaccaagaucccacguuauagagauuacacucccucaucauuguuaaaggccacacugauucaucagagugugaccggucucuaugagacucggaucgaccugucuaaacuuggcggggauuga

SEQ ID NO: 3214 - RNA, 4146 nt, Artificial Sequence
  Cas9 variant
augaagaaaaucauuggccuggaccucgggaccacaagcauaggaugggccuacgugcacgaggcugaauccgcacaggagagaucugaaaucgucaggcuuggugcccggguugugccccugacuacggaugagcaagacgaguucaagaaaggcaagucaauuaccacaaacgcggcucgcuugaguaaacgaucauuacguagaaaugccgauagguuucagcugcggcgcgacgaacuagcagggguaaugaaggaggccggauggaucgaugaaacuaccgugcucgcugagcagggcccuagauccacauucgaaacccugaggcuucgggcaaaggccgcuucugaggaggucacucuggccgaauuugcgcgcauuuugcuccagaucaaccgaaaaagagguuauaagucgaauaggaaaacagacggggaugaggaaggagcacugauagacggcauggaugugucaaagcaacugaacgccagcggccagaccccaggggaguggguucucgcucggaugcaggaaggaaaugccgugaucccggcauucuacugcagugacuuauccgaggagcuggaucguauuuggcgcaaacagcaggcuucucaucaagccuggaugacggaggaacuucacacugucuugagacaugcggacgguaggagcgccauccggcugauggauaaggcaggcgugguacccgacuccguuaacgugaaggaacgacgcagagucauguaugaguggagggcugccgcugugcgggacugucuaccugccgggcgcguggcagccgcucucaugcaggucucaaaagaaauuggcagagcggauaguuaccugggaaggaucggugaccguagcaaggagcuuuauuuucaccggcagaccguugggcaauaccuguggcgauugauaugcgauaauccaaaccagucucucaaaaaucugguguucuauagacaggacuaccaacaugaguuugaaacauuaugguccauucagacuaaguaccacguagagcugaccgaagaucucaggaaacgcgugggacggaucauuuucuuucagagaccccuuaagagcaaaaagggccuggucaacaggugugaguuggugcacuauagcguuugcgaaaauaguggcgacgaucuaacagagaagguggacgucgggccuaaaguguguccaaagucuuccccacuguuccaggaguuuaaaguauggcaaguucucaacaauguggaagucauccauccuagcacccaggaggcacgccgacuggaaauggaggagaaggaacuucuggccucggagcuacucuuccgggaucguaugaaaaagaucgacgugcugaaguuacuguuuucuaacuggagagaucuagaccucaauuacaaagaacuggagggaaacaggacgauggcugccuucuaucgcgucuacgaacaggugauugcacagacuggucacggcgacuaugauuucgccaagaugcgggcugccaaaguuaaggagcuugcagaggggguguuugcgggauugggcuucgaaguaggucugcucacauuugacgcugagcuggauuccccagccuacgaacaacagccgugcuauagacuuuggcaucuguuguacucauacgagggggacaaaagugcaaccggcaacaagugucuccugaagaaauuaugcaggcugacuggaaugaaugccgaauuggucggccucuucaugcagauacgauuuagcggggauuauggaucccugucuacaaaggcuaugcgccggauccuucccuacuugaaagccgguaacaccuaugacguggcaugugaguacgcuggcuucagacacagcgccaggucacugacgcgugaggaacucgcgcagaaggaguauaaagauuaccuggacuuacugccucgcaauagucuucggaacccaguuguggaaaagauuuugaaucaaaugauccacgucgugaacgggcucuccagcaccuauggaaagcccgaugagauaagaguagaaauggccagggagcugaaaaagucugcucgagagcgggaagagaugacaucagcaauuaguaaaacuaccaaggaaaaugccgagaucacagcuauccuacagcgcgacuuuggccugagauacgugagcaggaacgauauucuccgguacaaacuguauugcgagcuucgaaucaaggguaauggguguagaacuuuguacuccaacaccuauauuaauccuaacgaacuguucucucgcgaguuugacauagaacauaucauuccacagucgagguuauucgaugacagcuuuuccaauaaaacacucgagucacguaccgccaaccuggaaaagggcgaccggacugcaugggauuacguuaaugagaaguauggagcggagagagccgacgaauacagggcucaggucgaggcccuuuaucgcgauggcacgaucaguaaagcaaagcgagacaaacuguugaugcccggggauaagaucccggaagacuucauugauagagacauacggaacacacaauacaucgcuaaaaaggcccucgagauuuuugaagauuucgugccuucuguggucgcaaccagcggaaacguuacugccaggcugcgcgaggacuggggucuaguggaugugaugaaggagcugaauugguccaaauacgaaucacagggcaugguacacaucgaguaugaccgugaugggagacccauucggaggaucgucgacuggaccaagcgcaacgaccaucgacaccaugcuauggaugcgcucgccguggcauucacaaaaagaagcuacauacaguaucugaaucaccuuaacgcucggaaggaagccaccucuguugccuacgcuauccaacacaaagagauggaauuggacggauccaauagguggcgcuuuaagugcccauucggcgauagaagugcauuuaggcgggaggccaaggcgcagcuggagcguauuuuagugagcaucaaaucuaagaacaaaguccucacuccuuccgugaaucgcacaaagaaacgagguggguucaacaagaagguugaauggacgcccagaggcgcucugcauaaugagaccguguauggaaggauucggcgcuacgacguaaaagaacuuagagucggcucaaguuuuacugccgaggugaucgggaagguggcagauagcagguaucgggccgcucugaugcaccgacuagcagaguucggaggcgaccccaaaaaggccuuuacagguaaaaacucgcucgaaaagaauccccuguacaccgaugaggcgcauacagcuugcgucccuuccucuguuaaaguggugagcuucguagaaauagggacuauuagaaagggagucgacccaaacuugaauguggauaagguuguggacacccacaucaaaaacauucuguuagcccgccucucagcauacggcggugaugccaagaaggcuuuuaguaaucuggacgccgacccgaucuggcuuaacaaagagaaaggcauagcaaucaagagggucacgauuuccgaugacucugaagugcggcccauccacguuaagcgugauaugagagggaggcuggugugugacgagcauggacgcccugucccaagcgauuauguacaguugcggaacaaucaccauguggcuauuuuccgagacgccaacggcgagcucaaagaaagaguugugaccuuuuucgaggcggucgaaagggugcgccagcugcgguccgaggggagagccguagaagugaucgauaagaauuacaaaugcgaggagggauggacauuucuauucucaaugaagauaaacgaauauuucgucuuucccgacgcagcuagcggcuucgauccucgugagauugaccugacugauccagccaauuacgcucuuaucaguccccaccucuuuaggguucaaaaacugucuuccaaggacuauuacuuccggcaucacuuggaaaccacagugaacgaugugaagcagcugcgcgacaucacuuggaaacgaauuagcucguuacaggaccucgcagguaccgucaaggugagaguuaaucacaucgggcagauuguagccgugggagaguauuga

SEQ ID NO: 3215 - RNA, 4146 nt, Artificial Sequence
  Cas9 variant
auggugaagaaaaaguacgccaucggcauugacauagggaccaacagcgucggaugguccaucguuacagaugacuauaaagugcccucuaagaaaaugaagguauucgguaauacugagaagagauacauuaaaaagaaccugcucggcacgcuucuguuugaugaagggaauaccgcugagaacaggcgguugaaacgcacagcacgacguagauauacuaggcggcgcaauagaaucuuauaccugcaggaaauuuucgccgaggaaaucaacaagauagacgauucauuuuuccaaaggcuagacgauaguuuucucaucguggaggacaaacagggaagcaagcacccuauuuucggcacccugcaggaggaaaaggaguaucauaaacaguuuccaacaaucuaccaccuucggaagcaacuggcggauuccucucagaaagcugacauucgcuugaucuaucucgcccuggcacauauaauuaaguaccgaggucacuuccuguuugaaggggaucucaaaucggagaauaaggacguccagcauuuauucaacgauuuuguggagauguucgacaaaaccguugaaggaucauaccugagcgagaaucuuccgaacguggccgacgucuugguggaaaagguaaguaaguccagaaggcuggagaauauccuacacuauuuucccaacgagaaaaagaauggccucuucggcaacuuccuggcucuugcacugggguugcagccuaauuuuaaaacuaacuucgagcucgccgaggaugcuaagauucaauuuucuaaagaaacauacgaggaagaccuggaggaauuacugggaaagaucggugaugacuaugccgaucucuucaucgcgaccaagagccuuuacgacggcauucuguuggcagggauacuauccacgacugauucaaccacaaaagccccacugaguagcucuaugguuaaccgguaugaggagcaccagaaggaccucgcucugcuuaaaaauuuuauccaucagaaccuguccgauucauacaaggaaguguucaaugacaaauugaaggauggauaugccggcuacauugaggguaagacuacccaggaaaacuuuuaccguuucaucaaaaaggcaauagagaaaauugaagggagcaauuauuuuaucgacaagaucgaccgcgaggauuuccucagaaaacaaaggacauuugacaacggaaguauuccccaccagauccaucugcaggagaugcacgcuauuauacggcgacaagccgaauuuuacccuuucuuagucgagaaucaggauaagaucgaaaagauucugaccuuccgcaucccauauuacgugggcccccuagcgagaggcaaaucugaguucgccuggcucaacaggaaguccgacgagaaaauccggccuuggaauuuugaugaaaugguggacaaggagacgagcgcagaaaacuucauuacucgcaugacaaauuaugaucaguaccugccagaccagaaaguccuuccgaagcacucguugcuguaugagaaauuugcuguuuacaacgaacucaccaaggugagauacguaacugagcaagggaagucuuucuuuuucgaugccaauaugaaacaggagauauuugacaggacauucaagguguaucguaaagucaccaaggaaaaacugauggauuuucuuuccaaggaguucgacgaauuucggaucguggaucuguugggacucgacaaggacaacaaaucauucaaugcuagucuggguacguaccaugauuuaaagaaaauuguuagcgaggacuuucuggauaacuccgaaaacgaggacauccuagagaaugugguccucacccugacacuuuucgaagaucgagagaugauuagaaagagguuggaaaaauauaaggacgugcugacugaggaacagcgcaagaaacucgagcggagacacuacaccggcugggggaggcugucugccaaguuaaucaacggaauacgcgauaaaguaacacgaaagacuauccuggacuaucuuauugaugacggcaccagcaaucggaacuucaugcaguugaucaaugaugacacacucucauuuguugaugagauucgucuggcacaagguagugggaaagccgaagacuacagagcugaggugcagaaccuagcgggcucccccgcaaucaagaagggaauacugcagagccucaaaauugucgacgaacugaucgaggugaugggcuaugauccugagcauauugucguggaaauggccagggagaaucaguucaccaaccaagggcgcagaaauucucagcagcgguacaagaaaaucgaaaacgcuauaaagaaucuugacucaaacuugaauaguaaaauccugaaggaguacccaacuaacaaucaggccuuacaaaacgauaggcucuuucuguauuaccuucagaacggaaaagacauguauacggaugaagaacuggacauugaucaguugagccaauacgacaucgaucacauuaucccccaggcauucauaaaggacgauucccucgacaauaagguucugacaaaaucugccaagaaccgagguaaaucggacgaugugccuagccuagagauuguauauaagaaaaagaauuuuuggcagcagcugcucgacucccaacugaucucacagcgcaaguucgauaaccuuaccaaagcugaacggggcggguugacuaaugaggacaaggccagauuuauccagaggcagcuggucgaaacccgucaaauuacaaaacauguggcacgcaucuuagauacccgguucaacacuaagcucgacgaggcgggaaauagaauuagggauccaaaaguuaacauaaucauucugaagaguaaucuugugucucaguuucgaaaggacuaccagcuguauaaaguccgggaaaucaacaauuaccaccacgcucaugaugccuaccuaaacgcagugguagccacagcucuccugaagaaauauccccaguuggccccggaguucguguacggcgaguauccuacguacaauagcuauaacucccgcaagucagcaaccgaaaaaguucuguuuuacagcaauauuaugaacuucuucaagagaaucgucgugcacucuaagacuggugaggugaggauacggcccgucaucgaaguuaacaaagagacaggggaaauugugugggacaagaaauccaauuuucgaaccgugagaaagguauuaaguuauccacaagucaacgugguuaaaaagacagaggugcagaaucauggccucgaucgcggaaagccuaaaggcuucuacaacgcuaaucugagccccaggccaaaggaggggucugucgaaaaccuugugcccgccaaacaguccuuugacacuaagcguuacggagguuaugcgggcaucucaaauaguuacgccguucuggugaacgggauuaucgagaaaggaaagaaaaagagcaaggcugaaguaaccgaguuccaaggcauaucgauuuuggcacggaaagauuuugacaagaauccuaaacaguaucuccugaaccuagguuacaaggacaucaaauccaucauuaagcugccaaaguauucucuuuucgagcucgaaaaugggagcagaaggaugcuggccucaauauugaguacgaacaauaaacgcggcgagauccacaagggaaacgaaauguaccugccggauaaauuugucaccuuacucuaucacgcuaugcgagugaauagaacacuggagcccggccauaagaaauacguggaagcccaccggcaugucuucgacgagcuucugacuuacauuuuggaguauaacgaaaagaucguuggggcaaaggcgaauggaaaaaggauuguggaggccuacuccgcucgcaaggauaccgacaaccucgaggaacugugcaacucuuuuaucaaucuacugaaccuuacagcccucggcagcgcaguagauuucgaauuucuggguacuaaaauaccucguuauagagacuacaccccauccucauuguuaaaggcuacgcugauccaccagagcgugacagggcucuaugagacccggauugaucugaguaaacuuggaggcgacuga

SEQ ID NO: 3216 - RNA, 4146 nt, Artificial Sequence
  Cas9 variant
auggugaagaaaaaguacgccaucggcauugacauagggaccaacagcgucggaugguccguugugacagaugacuauaaaguacccucuaagaaaaugaagguguucgguaauacugagaagagauacaucaaaaagaaccugcucggcacgcuucuguuugaugaagggaauaccgcugagaacaggcgguugaaacgcacagcacgacguagauauacuaggcggcgcaauagaauuuuauaccugcaggaaaucuucgccgaggaaauuaacaagaucgacgauucauuuuuccaaaggcuagacgauaguuuucucauagucgaggacaaacagggaagcaagcacccuaucuucggcacccugcaggaggaaaaggaguaucauaaacaguuuccaacaauuuaccaccuucggaagcaacuggcggauuccucucagaaagcugacauccgcuugauuuaucucgcccuggcacauaucauaaaguaccgaggucacuuccuguuugaaggggaucucaaaucggacaauaaggaugugcagcauuuauucaacgaguuuguugagauguucgacaaaaccguggaaggaucauaccugagcgagaauauuccggacgucgccgauauccuuguggaaaagguaaguaaguccagaagguuggagaacguucugcaguauuuucccaaugagaaaaagaacggccuacucggcaauuuccugucucuugcucugggguugcaaccuaacuucaaaacuaauuuugaacucgcagaggacgccaagauucaguucagcaaagaaacauacgaggaagaucuggaggaauuacugggaaagaucggugacgauuaugcugaccucuuuaucgccaccaagucccuuuacgauggcauucuguuggcggggauacuaucaacgacugacaguaccacaaaagcaccacugucuagcuccauggugaaccgguaugaggagcaccagaaggaucucgcccugcuuaaagacuucauccgucagaaccugucagauagcuacaaggaagucuuuaaugacgcuuugaaagacggauaugccggcuacauugaggguaagacuacccaagaagauuucuacaaguuugugaaaaagacaaucgagaaaauagaagggagugacuauuucauugauaagaucgaccgcgaggauuuucucagaaaacagaggaccuucgacaacggaucuaucccccaccagauucaucugaaggagaugcaagcaaucauuauacggcaggcuaaguuuuacccuuucuuagaagagaaucaggauaaaaucgaaaagauucugacguuucgaaucccauauuacgugggcccccuagcccgcggcaacuccgaguucgcguggcucaauagaaaaagcgacgagaagaucaggccuuggaacuucgaugaaauugucgacaaagagacuucggccgaaaauuuuauaacacggaugaccaacuaugaucaguaccugccagaccaaaagguucuuccgaaacacucuuugcuguaugagaaguucgcaguguacaaugaacucacuaagguacgcuacgugacagagcaggggaaauccuuuuucuuugaugcuaacaugaagcaggagaucuucgacggagucuuuaaaguguauagaaagguuaccaaagaaaagcugauggacuuccuugguaaggaguuugaugaguucaggauuguggaccuguugggccucgauaaagacaauaagucauuuaacgccagucuggggacguaccaugaucugaaaaagaucgucagcaaagacuuacuagauaaucccgaaaacgaagacauucucgagaaugugguacugacccuuacauuguucgaggaucgugaaaugauccggaagcgacuggagaaguauaaagaaguucucacugaggaacagagaaagaaacuggagaggcgccacuacaccggauggggccgguuauccgcuaagcugauaaacgguaucagagacaaagugacaaggaagacuauucuugauuauuugaucgacgaugggaccucuaaccgcaauuuuaugcaacucauuaacgacgacacacugagcuucgucgaugagauccgacuagcccagggcucaggagaagcagaggacuaccgggccgaagugcagaaucuggcuggcaguccugcgauaaagaaagggauucuccagucccugaagaucgucgaugagcuuauugaggugaugggauaugaaccagagcacaucguuguggaaauggcacgugagaaccaauucaccaaucaggguagaaggaacagccagcagcgcuacaaaaagauagaaaaugccaucaaaaacuuggacucuaaucugaacucaaagauuuuaaaagaguaccccacuaauaaccaagcucuccagaaugaucggcuguuucuuuauuaccugcagaacggcaaggacauguauacggaugaggaauuggacaucgaucaacucagucaguacgacauugaucauaucauaccucaggccuucauuaaggacgacagccuggauaauaaaguacuaacaaaguccgccaaaaacagagggaagucugacgaugucccaucgcuggagaucguguauaaaaagaaguccuuuuggaaacagcuccuggacagccaacuuaucucacagaggaaguucgauaacuugaccaaagcagaacgaggaggccugacuaaugaggacaaggcucgcuuuauucagcggcaguuaguugaaaccagacaaaucacaaaacacguggccaggaugcucgauacccguuucaacacuaagcuggacgaggcagguaaucgcauucgggaucccaaggucaacauaaucacacuuaaaaguaaucuggugucucaguuuagaaaggacuaccagcuauauaaaguaagggagauuaacaauuaccaucacgcgcaugaugcuuaccucaacgccgugguugcaacggcccuguugaagaaauauccgcagcuggcuccugaguucgucuacggggaauaucccaccuacaauagcuauaacucccgaaagucagccacugaaaagguguuauuuuacagcaauaucaugaacuucuuuaaacggauugugguccacucuaagacaggcgagguucgcaucagaccagugauagaagugaauaaagagaccggagagaucguaugggacaagaaauccgauuucaggacaguccggaaggugcucaguuauccucaaguuaacguggucaagaaaacugaagugcagaaucacggccuggaccgagggaagcauaaaggauucuacaacgcaaaccuuagccccagaccaaaggaggguucuguugaaaaucuggugcccgcuaaacaguccuuugacaccaagcgcuacggcggguaugccggaauuucaaacaguuacgcgguauuggucaauggcaucauugagaaagguaagaagaaaagcaaggccgaggugacggaguuccaagggaucucgauacucgcuaggaaagauuuugacaagaacccuaaacaguaucugcuaaaucugggcuacaaggauauuaaguccaucaucaaacuuccaaaguauucucucuucgaacuggaaaacggaagccgucggauguuggcaucaauucugaguaccaauaacaaaagaggcgagauacacaaggggaaugaaauguacuuaccggacaaauuugugacacuccuguaucaugccaugagggucaaccgcacucuugagcccggacacaagaaguacguugagacccaccgacauguguucgaugaacuguugaucuacauucucgaguauaaugagaaaaucguaggcgcuaaggccaacgguaaaagaauuguggaagcauacuccgcgcggaaggacacagauaaucuggaggaacuaugcaacucuuuuaucaaucugcuuaaccucacugcccuggggagcgcugucgacuucgaguuuuugggaaccaaaauaccuagguaucgcgauuacacgccauccucauuacugaaggccacacucauccaccagagcgugaccggccuguaugaaacucguauugaccuuaguaagcuggguggcgauuga

SEQ ID NO: 3217 - RNA, 4146 nt, Artificial Sequence
  Cas9 variant
auggugaagaaaaaguacgccaucggcauugacauagggaccaacagcgucggaugguccguugugacagaugacuauaaaguacccucuaagaaaaugaagguguucgguaauacugagaagagauacaucaaaaagaaccugcucggcacgcuucuguuugaugaagggaauaccgcugagaacaggcgguugaaacgcacagcacgacguagauauacuaggcggcgcaauagaauuuuauaccugcaggaaaucuucgccgaggaaauuaacaagaucgacgauucauuuuuccaaaggcuagacgauaguuuucucauagucgaggacaaacagggaagcaagcacccuaucuucggcacccugcaggaggaaaaggaguaucauaaacaguuuccaacaauuuaccaccuucggaagcaacuggcggauuccucucagaaagcugacauccgcuugauuuaucucgcccuggcacauaucauaaaguaccgaggucacuuccuguuugaaggggaucucaaaucggagaauaaggacgugcagcauuuauucaacgauuuuguugagauguucgacaaaaccguggaaggaucauaccugagcgagaaucuuccgaacgucgccgacguguugguagaaaagguuaguaaguccagacaccuggagaauauucuacacuauuuucccaacgagaaaaagaauggccucuucggcaacuuccuggcucuugcacugggguugcagccuaauuuuaaaacuaacuucgaacucgccgaggaugcuaagauccaauuuucuaaagaaacauacgaggaagaccuggaggaauuacugggaaagauuggugaugacuaugccgaucucuucaucgcgaccaagagccuuuacgacggcauccuguuggcagggauucuauccacgacuaacucaaccacaaaagccccacugaguagcucuauggugaauagguaugaggagcaucagaaggaucucgcucugcuuaaaaacuuuauacaccagaaucuguccgacucauacaaggaagucuucaacgauaaauugaaggacggauaugccggcuacaucgaggguaagacuacccaggaaaauuuuuaccgguucauuaaaaaggcaaucgagaaaauagaugggagcaacuauuuuauugaaaagaucgagcgugaggacuuccuccgcaaacaaagaacauuugacaauggaaguaucccccaucagauucacuuacaggaaaugcaagcuaucauuaggcggcaggccaaguucuacccuuuucuggaggaaaaccaggauaagauagagaaaauccugaccuuccgcauuccauauuacgugggcccccuagcgcgaggcaagucugaguucgccuggcucaauagaaaauccgacgaaaagaucaggccuuggaacuuugaugagaugguggacaaagaaacgagcgcaaagaauuucaucacucggaugacaaacuaugaucaguaccugccagaccaaaaaguccuuccgaagcacucguugcuguaugagaaguuugcuguuuacaaugaacucaccaaagugcgcuacguaacugagcaggggaagucuuucuuuuucgaugccaacaugaaacaggagauuuuugacggaguguucaaggucuauagaaaagugacaaaggaaaagcugauggauuuucuugguaaagaguucgacgaauuuaggauaguugaucuguugggccucgacaaggagaauaaauccuucaacgcuucacuggggaccuaccaugauuuaaagaaaaucgugaguaaggacuuucuggacaacagcgaaaaugaggauauucuagagaacgucgugcucacgcugacccuuuucgaagaccgugagaugauccggaagcgauuggaaaaauauaaggauauucugacagaggaacagagaaagaaacucgagaggcgccacuacacuggauggggccggcuguccgccaaauuaaucaaugguauaagagacaagguaaccaggaagacaauccuggauuaucuuauugacgaugggacuucuaacugcaauuucaugcaauugaucaacgacgauacccucagcuuuguugacgagauucgccuggcacagggcucaggagaagccgaggauuaccgagcugaagugcagaaucuagcgggcagucccgcaaucaaaaaggggauacugcagucccucaaaauugucgacgagcugaucgaggugaugggauaugauccugaacauauugucguggagauggcccgggaaaaccaauucacaaaucagggucguagaaacagccagcagagguacaagaaaaucgagaaugcuauaaagaaccuugacucuaauuugaacucaaaaauccugaaggaauacccaaccaauaaccaagccuuacagaacgaccgccucuuucuguauuaccuucagaauggcaaggauauguauacugacgaggagcuggauauugaccaauugagucaguacgauaucgaccacauuaucccccaggcauucauaaaagaugacagccucgauaacaagguucugacgaaauccgccaagaaucgggggaaaucugacgaugugccuucgcuagaaauuguauauaagaagaaauccuuuuggaagcagcugcucgacagccaacugaucucacagagaaaauucgacaaccuuacaaaggcugagaggggaggcuugaccaaugaagauaaagcccgauuuauccagcgccagcuggucgagacucggcaaauuaccaagcauguggcaagaauguuagacacaagguucaacaccaagcucgaugaagcggguaaucguauccgcgacccaaaaguuaacauuauaacucugaagaguaaucuugugucucaguuucggaaagauuaccagcuguauaaggucagagagaucaacaauuaccaccacgcucaugacgccuaccuaaacgcagugguagccacagcucuccugaaaaaguauccccaguuggccccggaguucguguacggggaauauccuacguacaauagcuauaacuccaggaagucagcaaccgagaaaguucuguuuuacagcaauauuaugaacuucuucaagcgaaucgucgugcacucuaaaacuggcgaagugcggauucgccccgucaucgagguuaacaaggaaacaggagagauagugugggauaaaaaguccgacuuuagaaccgugaggaagguauuaaguuauccacaagucaaugugguuaaaaagacagaggugcagaaccauggccucgaucgggggaaaccuaagggauucuacaaugcuaaccugagcccccgaccaaaagaagguucugucgagaaucuugugcccgccaagcaguccuuugacacuaaaagauacggcggguaugcgggaaucucaaacaguuacgccguucuggugaauggcauuaucgaaaaggguaagaaaaagagcaaagcugagguaaccgaguuccaagggauuucgaucuuggcacgcaaggauuuugacaaaaacccuaagcaguaucuccugaaucuaggcuacaaggauauaaaauccauuaucaagcugccaaaauauucucuuuucgaacucgagaacggaagcaggcguaugcuggccucaaucuugaguacgaauaacaagcggggcgaaauucacaaagggaaugagauguaccugccggacaaguuugucaccuuacucuaucacgcuaugagagugaacaggacacuggaacccggacauaagaaauacguggagacucaccgccaugucuucgacgagcuucugauauacaucuuggaauauaaugagaagauuguuggcgccaaagcaaacgguaagcgaaucguggaagcguacuccgccagaaaagauaccgacaaucucgaggaacuguguaacucuuuuauuaaccuacugaaucuuacagcucucgggagcgccguagauuucgaguuucugggaacuaagaucccucgguauagggacuacaccccauccucauuguuaaaggcaacgcugauacaccagagcgugacaggccucuaugagacccgcaucgaucugaguaaacuugguggcgacuga

SEQ ID NO: 3218 - RNA, 4149 nt, Artificial Sequence
  Cas9 variant
augaagaaaaucgugaacuacaaucugggccucgacauugggaccagcuccauaggauaugccgcuaucgaugaccaggguagacccgucaggcaccaaaacaagacaguuaugggcgugcggcuuuucaaagaggggaagacugcagaaucuacgcgcauuuuucgaggaacccguagaaggcugucacaucggcacuggcgcuugggcuacuuagauagaaucuucgacaaugagauugccaaaguagaugaaaacuuucugccuaggcuaaaggcgaguaagcgggcucgcagcgacgagaaacgauccuucagagguucucuccuguuuccagaaacaggggaugacgccuauuaccagaaguauccgacuaucuaccaucuuagguaugcacugauaacccagaaaaagcaguucgauauccgguugauuuaccucgcccugcaccauaugaucaaauaccguggaaauuuucuggacacaacccccgugucggcuuucaacauucacgauaucgaccucacugaucaauuugcaucauuaaaugacugcuaucagcugcuugacauggauuucgaguuucaguucgacuugaacaauauagagcagguccaaaagcugcuacucgaugaaacacugagcaagaccaaacgccaggccgcugugaguaagguucuugugauguccacgggcaacaaagccuuugacgaucagcagaauggcauugcgucugaguucaucaaggcacugcucgggggaccuuucgacuugagcaaaauucugaacuuauccgucgccgaugugaagucauggaaacugcacaugacugacaaggauguagacgauacccucaauagucuuguugaggaacuggacgagaaccauaagcaaaucgugaauuugcuacagaugaucuacagccaggucaugaugcugggucuccugaacggccaacagucuauuuccgcuucaaugauagaaagauaugacgaucacgccaaacauugggcagcucuuaagaaacuguugccagcccucggggagcaggaacagagcacaaucauucacgcguacacugccuauaccggacacaguaggacaaagcaacugucucgggcagaguuuuacaccaaagugaacuccaucuuaaagaagcaugaaaauauagcugaggccacgggccugauugagcuaaucgaccgaaacgaauuuaugcccaaacagcgcgaugcugugaauggugucaucccucaccagcuccaucagagagagcugcaacuuauuauccagaaccagcagaaguauuacccauuuuuggccgcaaaagccuaccccgacgcugaugaaacuaugauugagcaacugcucagcuucaggguuccuuauuacgcggggccacugguggaccgggauuuuauaaaugaaucgucugaccaggagcaggcaaugcagaacacaaaguucuccuggcuuaaacgcagagaggccggagaaaucaccccguggaauuuugagcaaaagguagaugugcaggaaacugcuaacagguucauuaagcgucugacaaccaaagacacguauuugaugaccgaggauguccuccccaaggaaucacugaucuaccagcgguuugagguguuaaaugagcugaacgccauccgaauuaaugacagaaggcuaacagcagaaaacaaacaacucgccuuccagcagcuguuuauggcuggcaauacuaagaacguuaguaucaaaaaguuccgcaauuuuguguucgauagccuuaaguucccugagaaagucaagauaaccggcuuugccgggcagcacaacuucuuggcaaaacuguccacauaucaugacuuuaagaaaauuuucggagaacggguggaccacacugaucuccaaccagacuuugagagaaucguagagugguguaccauuuucgaagauaggcacaucuaccgcgagaagcugaaagaaauacagugguuaucucagagcgagaucgaccagcugguucuuauucgaaaccaugguuggggccgguugucaaagcgucuccugacagggaucagagauagugacggaaggaccgugauggaucaacuaugguuuggcacugacaauuucaugcgcauuaucucccagagcgauuuugcggcugccauagcaaacgaaaaucggacgcagcugaaccagcacggucucgaggacguccuggauucugccuucaugucaccccaaaauaagaaagcuauuagacaggugcuuaaggucguggacgauaucgagcagacauuggggugcccucccaaaaagguuaugauugaauuuaccaggaguccagacaaaaagaagcaacgaacugugacccgccuggagaaaguacagcaggccuauaaggcagucgcugaccaguuagccggccaaagcaucguguccgaacucgaucaguacgcgaacacacauucuaaacugucggacaccuacuaucuuuacuucaugcagcugggacgggauuuguauagcggcaagccgauagacaucgauuccccuaugcucgacgaugaccacauucugcccagagccuuuaugaaagauaauucacuagacaacagggcucugacugagaagccaaucaauaacacaaaggcagccaaauucccuaguaagguuuucgggcagcaaaaagaagugacggauuuuuggaagcuccugcgucgcuguggacuuaugucuaauauuaaagagaagcacuuguaccuggaccccgacaacgucgauaaguggacccggagagguuucauccauaggcaguuaguggagacuagccagguaauaaaaauuguggcuaauauccucaacgaccgauaucagcaaucccagacagaaguucuggaggucccagcccggcuuggcaccgaacugcgcgagugcuuugggugguacaaggugagagaagugaaugauuaucaccaugucuucgacgcauaccuagcggccuuuaucggaaacuaccucuauaggcgguaccccaaacugcagccuuauuucguuuacggcaacuuugcugaguugaauaaggcccagcugaaaaacauuaagucauucaauuucuuauauaacaucacagauaauaaacgaguggugaaggacauugagacuggucaaacccucugggaugaccagauaagacagcaaauccagcacauuuacgaauauaaguacaugcugacgagccaugaggcauucacccagcacaaagaacuuuacgggcagacaaucuauccacgcagggaguuuaagccgggcacucugaaagcuauuaagcaagaucagccccaggaguuguacggaggcuauaaaaaccucaccgccgcauacauguguaucguaaagauacaggcccguaagcggagagcugcggaauauagggucgugcgcguugccacagagucucuguccgcacuacaacaggcuaaacgacugggggugcaggccuacgaaagaugccuucggcaggagcucgucaggaauaacgaaauccugcgcacuaaugccgacccuaacagugcuccacgugaguucgagguguugcuggauagaguuuuaugucaccaaaugauuaucagcgacggacagaaguaucuccuggguucucaugcauacaaaauuaauugcaugcagcuugugcuguccaacaauucaaugaagaucuugaguaccagcauaguaaaacucaagcaaaugacgaacgaaccccugguccagguguaccgggagauucuagauguggucaauaaguauuucacacuguacgacguuaacucguuuagggaaaaccuuaaucaguucuuugacaaauuccgcacccucccuaucacuaacgaguaugaauccucuaagagcggcaaaaagcugauccaccgagggcaguuggagacauuaacccugauucucagaggacugcaugccaauucagauaaagugcaauacggcgaccagaguacucuucuggguggguuucagaccaaggauggcauaaaguuguccaaagacucuguaauccaguauacaagcccagcgggacuaaacgugcggacggucaagcugagggaucucgagcaaaaagaagcucagaaguga

SEQ ID NO: 3219 - RNA, 4149 nt, Artificial Sequence
  Cas9 variant
augguggacgagaagaucuucuggggccuggauauugggaccgacagcgucggaugggccguuacaaacuccgaauacaaacucaagaaauauaagaauaaccuuauguggggugugcaccuguuugaugaggcuaaacagucugcagaaagaaggucauuccggacugcccgccgacguuuggacagaaggaagcaacggauaaucuuacugcaggaguuuuucguacgcgcggugugcgaaaaggaugagaacuuuuucagaaggcuaaaagagagugcucuccugcccgaagacgccgagcaucggacgaauaauaucuuuuucgaugacccugauuacaccgacaaggauuauuuugaagaguacccaacaauucaccaucuuauuugugagcugauggaaagcaaagagccgcacgacguccgcuugguguaucucgcaugcguuuaccugcuggcccaucgaggccacuuccucuuacccguguccgaagaugacaucucuaaggucacugaguuugaaccucuguaugagucguucuacaaagcucuugaggaaaaguuggacgaugagccacccuuugacagaucagcagaugacuucgccgaaauacuuaagagccacaaaaccgugagugcuaagaacaaagauuucgacaagcuacucuuugggggaaaaguaaagacauacgauaaugagaacaucuccuauucugcccugauuaaacuucugagcggcgguaccgaaaaguuguccaaguucuuugcgaaugaggaguacacugaccucgaaaaagauucaguuugugugaggaacgcagacuucggggauacacuggagauguuagaaggacagaucgacgagcuggacuuugcccuccuuaagagugucaaaagccuguaugauuggucuuugcuaguggacauucuggaaggcaagucccucaucucagaggcuaaaaaggauaaguacgacgagcauggcuaugaucuggacgcccuuaaauaccuguuccgggaauauuugaccaaggaugacuacaaugagauguuuaaagaagugagcgggaagcagaacuacgcaaguuaugucuacaaugcuucuuccgauaaaacgcgugacagcaaguauaagaaaugcucgcaaaaggauuucuguaaauuuacuaagaaauuccucucuaagauaaagccuaacgagaaagacaagccaugccuggauaaauuacuggagaagugugaacaaaauucccuaugccccaaacagguuaccacagacaaccgcgugauuccuuaccagcucuauuacguagagcugaagaaaauccuugaaaacgccuguggauauuugccauuucugaaugagagagacgaauacgguacuguggcggauaagauucucucaaucaugaaguucagggucccguacuaugugggcccccugguugacaguaaaaagagcccuaacgccuggcuugugcggaaacuggaugggaagaucaccccauggaauuuuacagacauggucaacgaggaugaguccgaaaaugcauucauucgacgcaugaccugcaaauguacguacguggcuggacaggacguauugcccaaguauucucuccuguacagcaaguucucaguuuuaaacgagauaaauaacaucaaacugaauggcgaaccuauuagugugcagacuaagcaggagaucuauacagaacuauuugagagaaacaaauccagggucagcaagaaaaagauacgggauugccucauuucucacgguuacgccgcugacucagaugaggugaccgggaucgacgauaucgccaagagugcacugcgcagcuaucaugacuucaaaaagaugcuuuccaauggaauuuugacugaacagcaagucgaggaaaucauugagcacauaacagugaccacggauaacaucagacugaaaaaguggcucaaaacccaguuuccaaugcuggccgacgaagacguuaaguacauuacaaaguuaaaauacaaggauuauggcaggcugucucguugcuuccuugaggacguguugcccguagauacuaaaaccggcgaggcugaaucggacaagaauaucaucacaaugcucugggagacuaacgaaaauauuaugcagcugcuaagcuccaaauaccgguauucagagaacauagagcacaugaaccgacaauacuaugcgcugccggaaaaucauaagaguaugucugagagacucaaagauauguacgucccuaccgcagugaggcgcgccguuacacggaccuuugacaucgugaaggaacugaagaaaauucaggggagagaucccgacaagaucuucauugagauggcuaggggaacuggugaaacgccaaaaggcaagcgcacaaacagccgaaaagaucagauccuugagcacuggcauggguuggacaauaaggauauaaacgaccugaagaaauccggaaucugggagcacuuagacaccauugaugacgccaagcuccggucagauaaauauuuucuguacuucaugcagcuuggccguuguauguacacugaaaagccuauccccuuugaggaagucgagaaugaacauaaauggaacauugaccacaucuggccacaagcaaagauaaaggaugacagccuggauaauaaaguguugguaucuuccaacgagaaugguaagaaaagugacagcuaucccauuucugaugacaucagacacuccauggccgggcucuggcauucacuguacaagaaaggccuaauuagugagaagaaguaucagaggcugacccgcagcacaccuuucaccgaugacgaacucucgggauuuaucgcucggcagcugguggagacuagacaguccacaaaagccguugcaacgcuuuugaaggaacaauucccaaacaccgagauagucuacgugaaagcgggccuggugucugauuuuaggcaggaaauggggauguuaaagugccgagaggucaaugaccuccaccaugcuaaagacgccuaucugaacaucguucuuggaaauguguacaacacucgcuucacaaaggauccgcugaauuucgugaagaacaacgagaaauauagcauuaagaucuuucagaaaaauucagacgguaagaaaaccggcguaauuacacggaaggucgaaagagggggagagguggcaugggaucccgaaaccaguuucgccaucguuaggaaaaugauguccaagaacucuauacguuacgugcgcuacgcuuauaugagaaagagcggccagaaugguggguuuuucgaccaaaacccucuacggaaaggcaagggaauggucuccauuaaacacaaucucucaaucgagaaguacggcggguaugauaacgccacuaucagcuuuuucagucuggugucuauuaaagacuuuggaguuaucuugcuggcaguggaguuacucuccgcuaauaaguuccugaagaacauuagcgaagccaaagaguacgcggccgauaagcugucgaaagaacugaauguaaagauagucccaaacgacguggcuuuucccuugaauaacagguauaauguggucaaaaucaacgcaguucucgagcuggaugguuaccgagugaugauugccgcuaagcaaaauucaucuaucaaguucguaaguaacgaaucccuaauucugagcucucagcacauggccuaugugaaaaagaucacgaaauuuauagagaagcggaaacaggacaaggucuguaugaucaacgcauucagcggcauuuccaucgaggauaauauugaacuuuacgacgugcucguuucaaagugcaacaucaaaccuuucaauauaauguacgagaaccuggggauuaaguugagugauaaucgcgacaacuuuaucaaaaagagcguggaaaaucagguccugaucuuaucugagauggugagacucuucaaaaccggaaggaaggcgggcguuaaccuggaagaggugggugggcggaaaaauuccggcgucaagacacuuaacacuugucuguauaagguaaaagacuacucaaauauauuuuugguggaucagaguccaaccggacucauugagcauaagagccccaaccugcuagaccuguga

SEQ ID NO: 3220 - RNA, 4155 nt, Artificial Sequence
  Cas9 variant
augaacaagcccuacagcaucggccuggacauugggaccaauuccgugggauggucuauaaucacagaugacuauaaagucccugccaagaaaaugagaguucucgguaacacugauaaggaguacauuaaaaagaaucuuaucggcgcucuguuguucgacgggggaaacacggcagccgauaggcgguuaaagcgcaccgcgcgacguagauauacaaggcggcgcaauagaauccuguaccuacaggaaauuuuugcugaggaaaugucaaaaguggacgauaguuucuuucacaggcucgaggacagcuuccugguagaagaggauaagcggggcuccaaauauccaauauuugccacucuucaagaggaaaaggacuaccaugagaaauucucuaccaucuaucaucugcgcaaggaauuggcagauaagaaagagaaggccgaccuccgacugauuuacaucgcucuggcacacauuaucaaauuuagaggucacuuccucauagaggaugacucguuugacgugaggaacacagauauuucaaagcaguaccaggacuucuuagaaaucuuuaauaccacuuucgagaacaaugaucugcuuagccagaacgucgacguggaagccauuuugacagauaaaaucaguaaguccgcuaaaaaggaccggauccuggcccaauauccgaaucagaagucuaccgggauuuuugcggaguuccuaaaacucauaguuggaaaccaggcagauuucaagaaauacuuuaaucuggaagacaagacgccccuucaguucgccaaagauagcuaugacgaggaucuggagaacuugcucggccaaaucggcgacgaauuugcugaccuguucuccgccgcaaagaaguuauacgauucagugcugcucagugggauucuuacugucaucgaccugagcaccaaagcuccuuugucugccuccaugauacagcguuaugaugagcaucgcgaagaccuaaagcagcugaaacaguuugugaaggcgucacucccagagaaauaccaagaaauuuucgccgauagcaguaaggacggauaugcagguuacaucgagggcaagacaaaucaggaggcuuuuuacaaauaucugucuaagcugcugacuaaacaggaagauuccgagaacuucuuggaaaagaucaaaaacgaggacuuucucagaaagcaaaggaccuucgauaaugggagcauuccccaccagguacaccugacagaauuaaaggccaucauucggcgacagucggaguacuauccuuuucugaaagagaaccaggaccgcauagaaaagauccuaaccuucaggauuccauacuauaucggaccccucgcuagggagaaaucugauuuugccuggaugacgcggaagacugacgauuccauccgcccuuggaauuucgaagaccugguugacaaagagaagucagcagaggccuucauucauagaaugacaaacaaugauuuuuaccuuccagaagagaaaguguugccgaagcacagucugauauaugaaaaguucaccgucuacaacgagcucacuaaagugagguacaagaaugaacaaggcgagacauacuuuuucgacagcaacaucaaacaggagauuuuugaugguguguucaaggaacaucguaaagucuccaagaagaaacugcuugacuuucuggcuaaggaguaugaagaguuccggaucguugaugugauuggguuggacaaagaaaauaaggcguuuaacgcaucucucggaaccuaucacgaucuggagaaaaucuuagacaaggauuuccuggacaaucccgauaacgagagcauacuagaagacaucguacagacgcucacccuguuugaggaucgagaaaugauuaagaaaagacuugagaauuacaaggacuuguucacagaaucacagcugaaaaagcucuauaggcgccacuacacuggcuggggccggcugagugccaaauuaaucaacgggauuagagacaaggagucccaaaagaccauccuggauuaucuuauagacgauggaaggagcaaucgcaacuuuaugcaguugauuaacgacgauggucgaucuaaucggaacuucaugcagcucaucaaugacgauggccugucauucaaaaguauuaucagcaaggcucaggccgggucccauucugacaaccuaaaagagguggucggagaacuggcaggcucgccugccauaaagaaagguauccuccaaagccugaagauuguggaugagcuuguuaaagugaugggguacgaaccagagcagaucgucguggagauggcucgugaaaaucagacaacuaaccagggcagaagaaauucccgccaacgguacaaguugcuggacgauggaguaaagaacuuagccucagaccucaauggcaacauucugaaagaguaucccaccgacaaucaggcacuucagaacgaaagacuguuuuuguacuaucuccaaaaugggagggauauguacacaggagaggcgcuggacaucgauaaccuaagucaguaugacauagaucacauuaucccucaggcuuucaucaaggacgauucuauugacaaucgaguucuggugagcuccgccaaaaaccgcgguaagucagaugacgucccaagccucgaaaucgugaaagauugcaaggucuuuuggaagaaacugcuugacgcaaaguugaugucucagcggaaauacgauaaccugaccaaggccgagagaggcggguuaacuuccgacgacaaagcuagguucauucaacgucagcucguggagacgcgccagauaacaaagcauguugcccggauccuggaugaaagauuuaauaacgagcuugacaguaagggaaggcggauucgaaaagugaagaucguaacccugaaaagcaaucuagucucuaacuuccgcaaggaauuuggcuucuauaaaauuagagaggugaauaacuaccaccaugcacacgaugcuuaccucaaugccguuguggcgaaggccauccugacuaaguauccccaguuggaaccggaguuugucuacggugacuauccuaaauacaacuccuauaagaccaggaaaucagcuacagagaagcuguucuuuuacaguaauauaaugaacuucuucaaaaccaaggugacuuuagcagaugggacaguagugguuaaggacgauaucgaagucaauaacgacacgggcgagauugugugggauaaaaagaaacacuuugccaccgugcggaagguccucagcuauccccaaaauaacaucguuaaaaagacugaaauucagacaggaggcuucucgaaagaguccauccuggcucauggaaauucugacaaguuaauaccacgaaagaccaaagauauuuaccuggacccuaagaaauacggggguuuugauagccccaucguggccuauucaguguugguagucgcagacaucaagaaaggcaaggcgcagaagcucaaaacagugacugaacugcuagggauuaccauaauggagagaagucgcuucgagaagaacccauccgccuuucuggaaucuaaaggauaccuuaacaucagggcugacaagcucauuauccugcccaaauauagcuuguucgagcuggaaaauggccgucggagauuacucgccuccgcuggugagcugcagaaggggaacgagcuugcacugccuacgcaauuuaugaaguucuuguaccucgccucaagguauaaugaaagcaaaggcaagccagaggaaauugagaaaaagcaggaauuuguuaaccagcacgugaguuacuucgaugacauccugcaacuaauaaaugauuuuucuaaacgcgucauccuggcagacgccaaccuugagaagauuaauaagcucuaucaggauaacaaagagaauaucuccguggacgaacuggcuaacaauauuaucaacuuguucaccuuuacaagccuuggagcgccggccgcauucaaguucuuugauaaaauaguugaccgaaagagauacacuucgaccaaagaggugcuuaauucaacacucauucaucagucuaucacuggccuguacgaaacccggaucgaucuugggaagcugggagaggacuga

SEQ ID NO: 3221 - RNA, 4155 nt, Artificial Sequence
  Cas9 variant
augaagcugagaggcaucgaggacgauuacagcauugggcucgacaugggaaccuccucuguggguugggccgucacagaugaaaggggcacucuugcucacuucaaacggaagcccacgugggggucacgccuguuucgagaggcacagaccgccgcgguugcucguaugccuagaggacaaaggcggcgcuaugugagaaggcgguggcgcuuggacuuacugcagaaacuauucgaacagcagauggagcaagccgauccagacuuuuucauacgacucagacagaguaggcugcuucgggaugaccgugcagaagaacaugccgauuaccgcuggccgcuguuuaacgacugcaaguucacagagagagauuauuaccagagguuucccacuaucuaucacguacggagcugguugauggaaaccgacgagcaggcugauauucgacucaucuaccuggcacugcauaauauugugaaacaccgcggcaacuuccucagagaaggucaauccuuaucugccaagucggcuaggccugacgaggcccugaaucaucuucgggagacauugcgcgucuggucaagcgaaagaggguuugaguguaguaucgcggacaacggauccauacuggcaaugcuaacccacccagaucucucucccagcgacaggcguaagaaaaucgccccucuguucgaugugaaguccgacgaugcugccgcagacaaaaagcuaggcauugcucuggccggcgcgguuaucggguugaaaacugaauuuaagaauauuuucggagauuuuccaugcgaggacucaaguaucuaucucagcaacgaugaagccguggacgcaguccggucugcuugucccgaugacugcgccgagcuguucgaccgauuaugugagguguacuccgcuuacguacugcagggucuccuuucauaugccccuggccagacaauaagcgcaaauaugguugaaaaguacagaagguauggggaggaucuggccuugcuuaaaaagcuggugaaaauuuacgcuccagaccaguaucgcauguucuuuaguggagcgaccuacccgggcacggguaucuaugaugcagcccaagcucggggguacacuaaguacaaccucggacccaaaaagucugaauauaaaccuuccgagagcaugcaguacgacgauuucagaaaggccgucgaaaagcuguuugcaaaaaccgacgccagggcugaugagcgcuaucgaaugaugauggaccgguucgauaagcagcaauuucuucguagacugaaaacaucggacaauggcucuauuuaccaccaguugcaucucgaggaacugaaggccaucguggagaaccagggcagguucuauccauuuuuaaaacgcgaugcagacaagcuggugucccuagucucauuccggauccccuacuauguugggccucucaguacuagaaaugcgaggaccgaucagcacggagaaaaccgauuugcuuggagcgagcgcaagccagguaugcaagacgaacccauuuucccguggaauugggaguccauaaucgaccggucuaaaagcgccgagaaguuuauucugagaaugacaggcaugugcaccuaccuucagcaggaaccuguguugcccaaaucaagucugcucuacgaggaguucuguguacugaacgagcuuaauggggcacauugguccaucgauggagacgaugagcacagguuugacgccgcugaucgugaaggcauaauugaggaacuguuccgccggaagagaacggugagcuauggugacgucgccggguggauggagagggaacgaaaccagaucggcgcacacgugugcggaggccaaggggagaaaggauucgagucuaaguuggguucauacaucuuuuucuguaaggauguuuuuaaaguggaacggcucgagcagagugacuauccaaugauugaacgcaucauucuguggaacacuuuauucgaggauagaaagauacugagccagaggcuaaaagaagaguacggcucccggcucucugcugagcagaucaagacaauuugcaaaaagcgauuuaccggguggggaagacugucggaaaaguuccuuacuggcaucacaguccaaguggacgaggauagcguauccaucauggacguuuugcgcgaagguuguccugugucagggaaaaggggccgugccauggucaugauggagauucugcgggaugaggaacucggauuucagaagaaaguggacgacuucaauagagcguuuuucgccgagaacgcucaggcacugggcgucaaugaauuacccgggaguccagccgugaggcgcucucugaaccagagcauacgaaucguugaugagauugcuuccaucgccggaaaggcacccgcgaauauuuuuaucgaagugaccagagacgaggauccuaaaaagaaaggucggaggacgaagcgccguuauaacgaccuuaaggaugccuuggaggcuuucaaaaaggaagacccagagcucuggagagaacugugcgagaccgccccgaaugauauggacgaacggcuaucacuguacuuuaugcaaaggggcaaaugccucuauagcgggcgcgcaauagauauccaucagcugucuaacgcuggaauuuacgagguagaccacaucauuccccgaacauacgucaaggaugacucccuugagaauaaagccuugguguauagagaagagaaccagcggaagacugacaugcuguuaaucgauccugaaauaaggcgcagaaugaguggcuacuggaggaugcuccaugaggcaaagcugauuggugacaaaaaguuccggaaucuucugcguagccgcaucgaugacaaagccuugaagggguucauugcucgacaacucguugaaaccggccagauggugaaacuggucagaucucuacuggaggcgagguauccagagacaaacaucauauccgugaaggccucaaucagucacgaucuccggacugcagcugaacugguaaagugucgcgaggccaaugacuuucaucacgcccacgaugcuuuccuugcaugcagagugggauuguuuauucagaaaaggcaucccuguguuuacgaaaacccuaucggccugagccaggucgugcggaauuaugugcgacaacaggccgacauuuucaagagaugccgcaccaucccagggucguccggauuuauagucaacucuuucaugacaagcggcuuugauaaagagaccggugaaauuuucaaggacgauugggacgcggaggcugagguugaagggaucaggcggucauuaaacuuucgucaguguuucaucaguagaaugcccuuugaggaucacggaguguucugggacgccacuauuuacuccccgagggcgaaaaagacggccgcucucccucugaagcagggccuuaauccaucucgcuaugguagcuucucccgggaacaauuugcauacuucuuuaucuacaaagcccgaaaccccagaaaggagcagacacuguucgaguuugcacaggugccuguaaggcuaucagcucagauucgccaagacgaaaaugcccucgagcgguaugcaagagaacuggccaaagaucagggcuuggaguucauacguaucgaaaggagcaagauucugaaaaaccaguuaaucgagauugacggggaucggcucugcaucaccggaaaggaggaaguccgcaaugcuugugagcuggccuuugcacaagacgaaaugcgagugauaagaaugcuuguuagugagaaacccgugucuagggaaugcgucaucucccuguucaaccggauuuugcuccauggcgaucaggcuagccgcagacugucgaagcagcuaaagcuggcccuucucucagaggcguuuucugaggccagugacaaugugcagaggaacguugugcugggguugaucgcaauuuucaauggauccacuaacaugguaaaucugagcgauaucggcgguucuaaauuugcugggaacguccgaauaaaguacaaaaaggaauuagccagcccaaaagugaaugugcaccucauugaccaauccgucaccggaauguucgagcggcguacaaagaucggccuguga

SEQ ID NO: 3222 - RNA, 4158 nt, Artificial Sequence
  Cas9 variant
augaccaagcccuacagcaucggccuggacauugggacaaacuccgugggaugggccgucauaacugaugacuauaaaguuccuucuaagaaaaugaaggugcucgguaauacgucaaagaaguacaucaagaaaaaccuucugggcgcuuuguuauucgauagugggauuaccgcagagggaagaaggcugaagcggacagcccgccgacguuauacuagaaggcggaaucgcauccuauaccuccaggaaauuuuuagcaccgagauggcgacacuggacgaugcuuucuuucaaagacuugacgauuccuuccugguaccagacgauaaaagggacucuaaguauccgaucuuuggcaacuugguggaagagaaagucuaccacgaugaguuccccaccauauaucaucuccggaagcaccuggccgacucgucaaagaaagcagaucugcgccucguguacuuagcccuggcucauaugaucaaguaccgaggucacuuucuuauugaaggggacuucaauagcaaaaacaaugacuugcagaagaacuuucaggauuuccuggacacuuauaaugcaaucuuugagagugaucuaucccucgaaaacucuaaacagcuggaggaaauuguuaaggacaaaaucagcaaguccgccaagaaagauagaauacuuaagcuguucccuggagagaaaaauucaggcauuuuuagugaguucuugaagcucaucgugggcaaccaagcugacuucaggaaauacuuuaaucuggaugaaaagaccagcuuacaguucucuaaggaguccuaugacgaagaucuggagacacuccuugggcauauuggagacgauuacucagacgucuuucugaaagccaagaaauuguaugacgcgauccuacugagcgguauccucacggugacugauaacggcaccgaagcaccacugaguucugccaugauuaugcgguacaaggagcacgaggaagaccuugcucuguugaaagccuauauacguaauaucucccucgagacauacaacgaaguauucaaggauaacacuaagaauggguacgcaggauauauugacggcaaaaccagccaggaggauuuuuacguuuaucugaagcgcuuacuggcuggucuagaaggggccgacuacuuccucgagaaaaucgauagagaggacuuucugaggaagcagcggacauucgauaacggaucgauacccuaucaaauuuaccuucaggaaaugcgagcgaucuuggacaaacaggccaaguuuuauccuuuccuggcaaagaauaaagagcgcaucgaaaagauucucaccuuuagaaucccauacuacgugggcccccuggcuaggggcaacucugauuucgccugguccauucggaaacgcaaugagaagauaacgccuuggaacuuugaagacgucaucgauaaagagucaagugcugaggccuucauuaauagaaugacuagcuucgaccuuuaucugccagaagagaagguguugccgaaacacucccuccuguacgaaaacuuuacaguguauaaugaguuaaccaaggucagguucaucgcagaggggaugcgugacuaccaguuucuggauucuaagcaaaagaaggacaucguucggcuauauuucaaaggaaagcgaaaagugacugauaaggacauuauagaauaccuccaugccaucgaugguuaugacggcauugagcugaaggggaucgaaaaacaguuuaacagcucacuuaguacauaccacgauuugcugaauauuaucaacgacaaggaguuccucgaugacuccagcaaugaaaccauaaucgaggagauuauccauacgcugaccauguuugaagauagagagaugauuaaacagagguuaucuaaguucgacaacaucuuugauaaaucaguacugaagaaacuuagucgccggcacuacacaggauggggcaaauugagcgcuaagcucauaaaugguauuagagacgaaaaauccgggaacacuauccuggacuaucuaauugaugacggcgugucuaacaggaauuucaugcaacugauccacgaugacgcgcucucguuuaagaaaaagauaaagaaagcacagaucauuggagauaaggacaacaucaaacaggucguuaagagccugcccggcuccccugccauuaaaaaggggauccuucagucaauaaaaauuguggaugaguuggugaaggucaugggacgcgaaccagagaguaucgugguagagauggcucgagaaaaucaauacaccaaccaggguaagucuaauagccagcagcggcugaaacguuuagaggaaucccucaagggccuggggucaaaaauccuuaaggagaacguucccacaagacugagcaaaauugacaauaacgccuugcaaaaugauaggcucuaucuguacuaucuacagaacggaaaggacauguacacuggcgaggaacuggauaucgaccgccucucuaauuaugacauugaucauauaaucccucaggcauuccugaaggacgauuccauugacaacaaagugcuugucaguagcgccucuaaucgggguaaguccgaugacgugccaucauuggaggucgugaaaaagagaaaaacccugugguaccaguuacucaagaguaagcugaucagccaaaggaaauuugauaaccuuacaaaggcugaacgagggggccugucgcaggaggaaaaagccggauucauucagcgccagcuaguugagacccggcaaaucacuaagcacguggcaagacuccuggacgagagguucaauaacaaaaaggaugaaaacaaucguacguugcgcacaguaaagauaaucacccugaaauccucuuuagucagccaguuucggaaggacuucgagcucuacaaagugagagaaauuaacgauuuucaucacgcgcaugacgcuuaucugaaugccguuguggcaucagcccuucugaagaaauaccccaaguuggagccggaguucgucuauggcgauuacccuaaguauaacaguuuuagggaacgaaaauccgcuacugagaagguguacuucuauucuaauaucaugaacauuuuuaaaaagagcaucccccucgccgacgggaccguaauagaccggccacugauugaagugaaugaggaaacaggagaguccguuuggaacaaagucgcagaucuaaauaccgugcgcaaggugcugucauacagccaggucaacaucguuaaaaagguggaggaacaaaaucacggucuugacagaggcaagccuaaaggacucuucaacgcuaaucugaguucuaagcccaaaccaaacuccaaggagaauuuggugggggccaaagaauaccuggaucccaagaaguauggcgguuacgcggggaucagcaacucguuugccauuuuaguaaaaggcacuauagagaagggagcuaaaaagaaaaucacaaacguccucgaguuccagggcauuucaauccuggacaggauuuauuaccggaaggauaaacuuaauuuucuguuggaaaaaggguauaaggacaucgaacucauaaucgagcugccuaaauacucucuauucgagcugagugauggaucccgaagaaugcuugcaagcauucucucuacgaacaauaagcgcggcgaaauccacaaagguaaccagauuuucaucagccagaaguuugugaagcuguuguaucaugccaaaaggauauccucaaccuucaaugagaaccaccguaaguacguugaaaaucauaaaaaggaguuugaggaauuauucuacuauauucuggaguuuaacgaaaauuacgugggggcuaaaaagaacggagagcuccugaaaagugccuuccaaagcuggcagaaucacucuaucgacgaacuuugcuccucauuuaucggcccaacugguagugagcggaagggccuguucgaguugacaagcagagggggagcagcggauuuugaguuccuaggcgucaagauuccgagguaucgcgacuacacccccuccucucugcucaaagaugccacacugauccaccagucggugacugggcuuuaugaaacccgaauagacuuaggaaagcugggcgaagauuga

SEQ ID NO: 3223 - RNA, 4158 nt, Artificial Sequence
  Cas9 variant
augcagaccuacuucggcaugaagaaaauccuggggcucgaccuuggaacaaacagcauugguugggcccuggugaaugaggcuaacgaugacaaugaaaaguccucuauaaucaaauugggcgucagaguuaaccccuuaacuguggaugagcaaucaaauuuugaaaaggggaaaaguauuacgaccaacgcagagaggacaaucaagcggagcauucgccgaucccugcagcguuauaagcuaagaagggaaaaucucaucgagauacugaaagagcacaacuucaucacugacgauaccauucuuucugaagacggaaaugccucgacauuugagaccuaccggcugcgcgcgaaggcugccucagaaaagaucagcuuggaggagcucggcagaguacugcugaugauuaacaagaaaagggguuauaagaguucccggaaggcaaagaaucaggaagaggggcagcucaucgauggaauggaaguggccaaggaguuauacgaaaagaacauaacuccuggccaauucgucuuucagcugcuuaagcagggcgggaaauucauuccagacuuuuaucgcucugauuugcaggcugaguucgacaagaucugggaguuucaaaaacuguuccaugcagaaauucuaguggaugacuuuaagaagcagcucgagcgaaaaggaaagcugaauagcuccaaaaucuuccuugguagauuuggcaucuacacagccgaaaacaaggggaaugauaaaaggcugcaggcuuaucaguggcggguugacgccuugaccaaggagcucacgaaggaggaacuggcguacgugauuucagacuuaaacggaauaaucaguucaucuuccggcuaccuggguucaauuagcgaucguaguaaagagcucuauuucaacaaucaaacugucgggcaguuccuuauggcacagcuggaccacucuccgcauaccuccuugaagaaccaaguguuuuaccgccaggauuaucuagacgaguucaauacacugugggaaaaccaggcccacuaccauaaaguacucacuagcgaucugaagucggaaaucagagacguuauaaucuuuuaucagaggcggcuuaaaacccaaaagggacugauuucuuucugcgaguuugaaucccgaaagaucgagguggagauugauggcaaaaagaaaaucaagaaugucggcucacgcgugugucccaaaaguagcccuauuuuccaggaauuuaagauauggcagaucuugaacaauauugagcuccuggaaaaguccucuaaagcuaagagauucuuagaccaggaggagaaagaacugcuauuuaaggagcucagcaucaaaucaaagaucaguaaauccgaugcccugaaacuuuuguucaagaacagcagggaacuggaccucaauuacaaagagauugaagggaaccggacacaaucugcacuguuugaugcuuauucaaagauaaucgagcuuaguggacacggugaguacgacuucagcaaaauggaagccuccaauauuaucgagcuggugcaggaagucuuuaccggcuugaacuacaauacggagauucucuauuucgacucuucgcuggaagggaaggauuucgagaaccagccaauguaccgcuuauggcaucugcuauauagcuuugagggagacgauuccaaaacuggcaaugaaaagcucaucaacaagcugucagagcuuuacgguuucgaaaagaaguauaguauaguuuuggcgaacgugucuuuucaggaggacuacgggagccuguccacaaaagccaucagaaagauucaccccuaucucaaagaaggcauccaauacgauguagcaugcgaguucgcuggauacaggcacucaaagagcucucugaccaaggaggaaauugagaauaaaaucuuaaaggaccagcuggaaauacuuccuaaaaacuccuugcguaauccaguggucgagaagauucucaaccagaugaucaaugugguuaacgcccugaaugagaguuauggcaaacccgaugaaauucggaucgagcuagcucgagaacugaaaaagagcgccaaagagagagaggaacucacugcaucuauaggggagacaaccaucaagcaugaaaaauacagggccauucuggagaacgaauuuggaaucucccacgugucacgcaaugacauuauccgguauaaacuuuacuuggagcuggaaaacagagguuauaaaacguuauacaguaauaccuaugucagccaggagaaacucuucucgaaagaguuugauauagaccacauuaucccucaauccugucuguucgaugacucuuuuagcaacaagacacuugaaucaaagagugugaauaucgagaaaggcaacgauacugcuuucgacuacguauuugcgaaguacggggaagcaggacuguccgacuauauuauccauauugaggaauuguucaaagauggcaagauaucuaaaaccaagcucaauaagcugaaaaugaaggguaacgagaucccaagcgacuuuauugccagggauauccgcgacacacaguacauugcucgaaucgccaaaaacauacuagaggaaacuguucggaauguggucuccaccucagggagcaucacagaucgucugagagaggacuggcagcucauugaugugaugcaagaacugaacugggagaaguauagugcacuuggcuugaccgagaucuacgaaaauagggagggacacacuauucgccggaucaaagacuggacgaagagaaacgaucauaggcaccaugccauggacgcucugacaauagccuucaccaagcgaucucacauucaguauuuaaauaaccucaaugcacgcuccgauaaaagcggcucgaucuacgggaucgaaacuaaggagcuguaucgggacgaucacggaaaacuuaaguucaaaccgcccauuccucugaacgaauuuagagcggaggcuaagaagcaucuagagaauacccucauaucaaucaaagccaagaacaaagucgcaacaauuaauaucaacaccacuucuacaaaggaagguaaaaauaagaagaggcagcugacgccacguggccaguugcaccuggagaccauuuacgggaguauccaacaguacgugacuaaacaggaaaagguuggagccuccuucaacgaggaacagauaagcaaaguggcuaagcaaaaauaucgccaggccuuacucaaucggcugagagaguuugacaacgaccccaagaaagcauucacaggcaacaauucuuuugagaagaacccuaucuaccuugauguacugcagacccagaaggucccagacaaaguggaaacaguuagcaaggagauuaucuauacuauuaggaaagauaucacccccgaauugaagauagagaaagugauugacaagaagaucaaaacgauccuccaaucccgacugaaugaauacucaggugauaguaagcgggcuuucagcaaccuaaaagagaauccgauuuggcugaaccaggagaaggggaucgaaauaaaacgcgucaccauuucuggcaucuccaaugccguggcgauucaugacaagaaggauaaaaacggaaaucuuauccucgacaacgagggcucaacacaggccguagauuuugugaauacugggaacaaucaccacguugcuauauauaaggacgaaagaggaaaccugcaugagagugucgugagcuucuuugaggcaugcaccagggugaauuugggcgguccugucauuuucaaaaacuacaauaaguccgaugggugggaauuucuguucucuaugaaacaaaacgaguauuucguuuuucccaacgaaaagacaggauucaauccaaacgagaucgacuuacucgacccugauaauuaccggcugaucucgcccaaccuuuuucgagugcagaagauuagcagcaaaaauuacguguucaaccaccaucuggaaacuuccgccaucaccggcgagacguugaagaauaaaaagcagcucaguucuguaacauaucacuuuauucagagccugccacccauaaaagacaucgucaaggugagaauuaacaauaucggucaaaucguuugggugggcgaguacuga

SEQ ID NO: 3224 - RNA, 4158 nt, Artificial Sequence
  Cas9 variant
auggacgagcugcagaacuucgaaaagggcaaaagcaucaccacaaaugccgauagaacugcugggagguccaugcggcgcaaccuccaacgauacaaacuucguagagagaaucugauugaaguguugaaagaguauaacuuuauaacggacgaaaugaucuuaucugagaauggaaacaggaccacauucgagacuuaccggcugcgcgcaaaggccgcggucgaagagauuucacuagaacaguuugcuagaguucuccugaugaucaauaaaaagagggguuauaagaguagccggaaagccaagggcgcagagaacgggacccuuauugauggaauggagguggccaaaaagauguacgacgaaggcaucacacccggugagcugugcuugcagcuccugaccgcugggaaacgcuauuucccugauuuuuaccgauccgaccugcaggcagaguucgauagaauauggaauuuucaaaagcaguucuauccagacucucucaucgauaagguaaaagacgaggugaggggaaagaacaaaucgcagacuugggccauuuuagcuaaguacuuugucuggaaagaaguggaaaauucauggaacgaggaagaggcccagacacggcguguugaaaaggaguaccgccuggugggcaucaaaagaggcgucaagagggaagaacuuaaguuggagaauuuccaauggcgggugaaagcgcugagcgaacgaaugaacccggaggaacuagcaauuguacuccaggagaucaaugaacagauaaguaacuccucuggguaucugggagccauuagcgaucgcuccaaggagcuuuacuuuaacagacagaccguuggucaauaucagauggcugugcuggacaauaaccccaauaucggcuugaggaacauggucuucuaccggcagggguaucucggagaguuuaauacgauuugggaaaaacaagccgaguuccacaaggaacugacugaggaucucaaaaaggagauccgcgacaucgugauuuucuaccagagaaggcugaagucacagaaaggccucauaaacaucugugaauuugagcgucggcagauugaaguggagaucgacgguaagaaaaagauaaaaaccauugggagucgagucaucccuagaagcucuccacuuuuccaagaauuuaagaucuggcagacacugaaugauauugagguuuccguguugggaguaaagaacaaaaggaagaaacaggacgauaauucaacuacccuacuggacagcgcagagaacaucgauagucucaagcugaaugugucucgcccccuugacgcugaugaaaaaucccuguuggccaaggaguuauucauucgggacaagcugacaaaaagcgaugucuuaaagcugcuauuuaacaauccucagaaccucaaucugaacuucaaaaacauagacggcaauagaaccggcucggcgcuuuaucaagccuuuucuaagaucuuggaaauuuccgggcaugagucaaucaacuucaaaaagagugcagaugaaaucguggagcagguuaaaacgauuuuuagcgcucugggauggaauacugaggugcucugcuucgacuccgaaaaggagcuggacaagcagccauacuuuaaacuuuggcaccuguuguacucuuucgaaggugauagcacacccaccggcgacgggaaccucauacagaagaucgccgaucuguguggauuugagaaagacuaugcuucaauuuuagccaauaucacuuuccaagaagauuacggcagucuguccacaaaggcaauuaggaaaauccuaccucaucucaaggacgguaaccaguaugaugucgccugcgaguacgcuggguauaagcacagcaaaucuucacugaagaaagaggaaauaaagaauaaagugcuuaaggacaaguuggagcugcucccaaagaacagucugcgcaauccgguaguugaaaagaucuuaaaccagauggugaaugucauuaacgcgaucauuaccacguacggcaaacccgaugagauccgaauagagcuggcacgggaacuuaagaaaaaggccaagaaacgugaggaauugaccaagacaauuguggacacuaccaaaacacaugagggaaucagagcuauucuccagaaugauuucggcaugagccacgucuccaggaacgccaucauacgcuauaagcuguacgaggagcuaaaagacaauggguacaagacucuguauucuaacaccuacaucccuaaagagaagcucuuuucgaaggauuucgacauugaacacaucauuccacaagcacggcuguuugacgauagcuucuccaacaaaacacuugaggugaagucaaucaauauagaaaaaggaaguaagaccgccuaugacuuuguugaggaaaaauacggugagcagggcuugcaggaguaucugaacagaugugaaguguuauucagggauaagaagacuaaacuccgaaagcugaaaaugcaagagucugaaauucccgagggguuuaucgaccgcgaucuucggaauacgcaguacaucgcuaagaaagcccugagcauguugaacgaaauuugcagaaggguagucgcaacaaccggagcgaucacugacgagcuccgugaggauuggcagcugguggacguuaugaaggaacuaaauugggagaaguauaaagugcugggccucgucgaauacuucgaggauaacgacggucgccugauugggcggauaaaggauuggaccaaaagaaaugaccauaggcaccaugcuauggaugcccuuacaguggcauuuaccaaggacguauucauccaguacuuuaacaauaaaaacgccuccuugaagccugacacuaaugaggcugccauucgaaacaaguauuuccaaaauggcaaagcaaucccacccaugucacuggaugaauuucgggcugaggccaagaaacacuuaaacgacacacucauuagcaucaagacgaaaaauaaggugguuaccauaaaccugaaccgcacuaagaaaaagaauggaaucaacaaaaagcagcagcagacaccgagaggccaacuucaccuggaaaccgucuacgggucucauaaacaguauguggugaaggaggaaaaagucaaugcguccuucgaugccgcuaagauugcaacaguuaacaagccugccuacagggacgcucuacuccggcgacugcaggagaauggaaacgauaguaaaaaggccuucacugguaaaaauagcuuggacaagcagcccguguggcuggaugcaaaacaaaacgagugugugccagaaaagguaaagaccgucauguuagagacgguguauaccguuagaaaaccuaucgacgaaaagcucaauguggauaaagucguggacgcgcgcauuaggaagcugcuucaggaucguaucaaagaguacggcaacgccaagucugcuuuugccaaucuggacgaaaaccccauaugguugaauaaggagaaagggauuacaaucaagcggguuuccgugucaggaaucaguaaagcacagagccuccacgagaagaaagacaaggauggcaacuucauucuggacaaggauucgagaaggauaccaguagacuuugucaauacugguaacaaucaucacguggcuaucuaucgcaaacccgugcuagauaagaaagggcaagccgucuucgacgaaaacggcgagcugaaguuugaacuugaggaaguugugguauccuucuuugaugcagugacccgagucaaccucucucagccuauuaucgacaaagauuacaagagaagcgagggauggaaauuccuguuuucaaugaagcagaaugaguacuucguguuuccaaacgaaaagacaggcuucgacccgaaagagauugauuugcugaaucccgaaaacuaugccuuaaucaguccuaaucucuuccggguucagaagauagcuuccaaagacuacguguuuaggcaucaccuggagacugucguggcggaucgcaaggagcuucaagaaaucaccuggaaacguauuucuagccuguccaucuugaacagaauuaucaagguucgggugaaucacauagggcagauugucaugaucggagaguauuga

SEQ ID NO: 3225 - RNA, 4158 nt, Artificial Sequence
  Cas9 variant
augaccaagcccuacagcaucggccuggacauugggacaaacuccgugggaugggccgucauaacugaugacuauaaaguuccuucuaagaaaaugaaggugcucgguaauacgucaaagaaguacaucaagaaaaaccuucugggcgcuuuguuauucgauagugggauuaccgcagagggaagaaggcugaagcggacagcccgccgacguuauacuagaaggcggaaucgcauccuauaccuccaggaaauuuuuagcaccgagauggcgacacuggacgaugcuuucuuucaaagacuugacgauuccuuccugguaccagacgauaaaagggacucuaaguauccgaucuuuggcaacuugguggaagagaaagccuaccacgaugaguuccccaccauauaucaucuccggaaguaccuggcagacucgacuaagaaagccgaucugcgccucgucuacuuagcucuggcacacaugaucaaguaucgaggucauuuucuuauugaaggggaguucaauucgaaaaacaaugacauccagaagaacuuucaggacuucuuggauacauacaaugccauuuuugaaagcgaccugagucuagagaacuccaaacagcucgaagagaucgugaaggauaaaauaucuaagagcgcuaagaaagacagaauacugaagcuguucccuggagagaaaaauuccggcaucuuuucagaguuccugaaguugauuguuggcaaccaagccgauuucaaaaaguauuuuaaucucgacgaaaaggcgccacugcacuucaguaaagaaagcuacgaugaggacuuagaaacccugcucggguauaucggagaugacuacucugauguguuucuuaaggcaaagaagcuguaugacgccaucuugcuauccgguauucugacggucacugacaacggcaccgaggcuccccucucaagcgccaugauaaugagguacaaagagcaugaagaggaucuggcacuucugaaggcuuacauccggaauauuaguuuggaaacauauaacgagguguucaaggacgauacuaaaaacggguacgccggauauaucgacggcaagaccucucaggaagauuuuuacguacaccucaaaaagcuguuaguuggucuggagggggcggacuauuuccuagagaaaauagaucgugaagacuuucuccgcaagcagagaacauucgauaauggauccauuccuuaccagauccaucugcaagagaugagggccauccuugacaagcaggcaaaauuuuauccauucuuggcuaagaacaaagaacggauugagaagauccugaccuuucgcauucccuacuacgugggcccucucgcccgaggcaauagcgauuucgcuuggucgauaagaaaaaggaacgaaaagaucacgccauggaauuuugaggacgucauugauaaagagucuuccgccgaagcauucaucaaccggaugacuucauucgaccuguaucuuccggaggaaaaggugcugcccaagcacaguuugcucuacgagacauuuaauguguauaacgagcugaccaaaguccgcuucaucgccgaaagcaugagagacuaccaguuuuuagauuccaagcagaaaaaggacauuguuaggcuguauuucaaaaauaagcgucgggugacugauaaggacauaaucgaguaccuacacgcuauugauggguaugacggaaucgaacucaaagguauugagaagcaauuuaacucuagccugucaacauaccaugaucuuuugaauaucauaaacgacaaagaguuccuggaugacaguuccaaugaagcgaucauugaggaaaucauucacacccucacgaucuuugaggaucgagaaaugauaaagcagagacugagcaaauucgagaacauuuuugacaagucuguauuaaagaaacugucaaggcgccacuacaccggcugggggaaacuuagugcaaaauugaucaauggcauucgggaugaaaagagcggaaacacaauccucgacuaucugauagacgaugguguguccaacagaaauuucaugcagcuaauccaugacgaugcccugucuuuuaaaaagaagauuaaaaaggcucaaaucauuggggacaaagauaacaucaagcaggucgugcaggcccucccuggcaggccagcaauuaaaaagggcauucugcagucgaucaaaaucguugacgagcuugugaaggucaugggacgccgacccgagagcauugugguagaaauggcccgggagaaucaauacacuaaccaggggaaguccaauucacagcagcguuugaaaagacuggaagagaguuuaaaggaacucggaucuaaaauccugaaggagaacauuccugcuaaacuuagcaagauagauaauaacgcccugcaaaaugacagguuguaucucuacuaucugcagaacgguaaggauauguacaccggcgaggaacuagacaucgaucgccuguccaauuaugacauugaccacaucauuccacaggcauuccucaaagauaacucaaucgacaauaagguucuggugagcucugcguccaaccgggggaaaagugaugacguccccagccuugagguggucaagaaaagaaagacauugugguaccagcuguuaaagucuaaacucauaucccaaaggaaguuugauaaucugacuaaagcugaacgaggaggccuuucaccggaggccaaggcagguuucauccagcgccagcugguggagacccggcagauuacaaaacauguugccagacuacucgacgaaagguucaacaacaagaaggaugaggacaauaaaacccugcguacugugaagaucauuacguugaaaaguagccugguaucgcaauuucgcaaggauuucgaauuauacaaaguccgggagaucaacgacuuucaccaugcucacgaugccuaucucaaugcagugguugcuuccgcccugcuuaagaaguacccuaaacuggaacccgaguucguguauggggacuacccaaaguauaacucuuuuagagagaggaaaagcgcgacagaaaaggucuacuucuauucaaauauaaugaacauuuuuaaaaagaguaucuccuuggccgauggcaccgugaucgagcgaccucucauugaaguaaaugaggaaacuggagagucuguguggaacaaaguugcugaccugaauaccguccggaaggugcuaagcuacucccaggugaacauagucaagaaaguugaggaacagaaucacggccuggaccgcgggaagcccaaaggacuuuucaacgcaaaucucucaagcaagccaaaacccaacaguaaggagaaucuggugggugccaaggaauacuuggauccuaaaaaguauggcggguacgcuggaaucucuaacuccuuugccgugcugguaaaaggcacaauugagaagggugcaaagaagaagaucaccaacauuuuagaguuccaagggaucagcauacucgacagaaucacuuauaggaaagauaaguuuaauuuccugcuugaaaaaggcuacaaggacauugaucugaucauugaguugccaaaauauucacucuucgaacugucagacggaucucggcgaaugcuagcgaguauccuguccacaaacaauaagagaggcgagauacauaaggggaaccagauuuuuaucagccagaaauacgucaaacuucucuaucacgccaaacgcaucucuaauacguucaacgauaaucauaggaaguacguggaaaaccacaaaaaggaguuugaggaacuguucuacuauauuuuggaguuuaaugaaaacuacguuggagcuaaaaagaauggcgaguuacuuaagagcgccuuccaguccuggcaaaaccacucaaucgacgaacucugcaguagcuuuauagguccgaccgggucugagcguaaaggacuguucgagcuuacuucccggggcggugcagcugauuuugacuuccugggcgugaagauucccagauauagggauuacacaccuucaaguuugcuaaaagacgccacccugauccaucagagcgucacagggcucuaugaaacucgcauugaucugggaaaacuuggcgaggacuga

SEQ ID NO: 3226 - RNA, 4158 nt, Artificial Sequence
  Cas9 variant
augaagaacaaaaccugguaccugggccucggggugggacccacaagcaucgguugggccgcuacugacuccaauuauaagcugcugagaaagaacaagaaaagguuguggggcguccgguuauucgaggaagcaaagacggccguugaucgccgaaccuuucgugcggagagaaggcggcuggcucgcagaaaguggaggauuucucuacucgaggagcuguucgccaaagaagugucaaagaaugacccuaacuuuuuccuucggcugaaagagaguaaguaccacuuugaggauaagagcuugaugaaugaauauauacucuucaacgacaaggauuacacagacaaggauuauuacaaagaguauccaacuaucuaccaucugcgccugucccucaccacagaagagaauccggacauucgaaagguauacuuagcagugcacucuaugcugaaaaacagagggcauuuucuuuugcagggacaaucguucaaugauucaaacaucgacagcgucauuaaggagcugcuagaacucgagaccgugaaaaucaauuuugaaguuacugaugaggugauacacagucugaagaaaaucgcccuugaaaagaagaaccuguccgacaaaaauaacgaugucaagaaauuguaucccaaggagaaacagcuccaggagauuuucaagcugguguuuggcgguaagacaucuuuagacaaacuguacgacaucgaagaguauaaggaacucgauaauagcguaaaauccauuucauucaaggagaaaguuuacgaagaggugaggccugacuaugagcagauccuuaguaacuacauagaacuguuggaucuagcuaagcuggucuaugacagcauugugcucgcagauaucaagaaagaggggaagaccauuucugaauccaaaguggagcuguacaacaagcauaaagacgaucuugccaaucugaagaaguuggucaaaaucgacucaaagcucagcgaagauaaaaagaaagagguuuacuuuacgaucuucaaggaggacaaagaaaagggaacuaacuaugugaauuacacccaccggagucaagagggcaagucuugcuccuaugaagauuucaaaaaguuucugaaaaaggaguuagagaaacuggaagacagcccaacaaagacuaccauucuagaggaacucgaccuggagacauuccuucccuugcagcguaccaaggauaacucgguagugccuuaccagauacacaaagaggaacuggucaagauccucgacaaugcugccaaauaucauucuuuucuggcggagaaggaugacuccggcuacucaacgcgcgaaaaagugguucagcuuuucgaguuuaggauuccauauuacaucgggccccugaacgcacaccauaauacugaaaacggagguuacaguugggccauaagaaagaagggcauggagagcgugccugucacaccauggaauuucaaagaugugauugacgaauccgcuucugccgaggcauuuguaaacaauuugaagaacaaaugugcuuaucucagcggggaggauguucugccgaaaaauucauuacuguacagugaauaugcccuacucaacgagcugaaugcgcuucgguacgaaggaaaccgaaucuccguggaggcccgcgacgucaucgugaccaaauuguucaaggaacaaggcaagaaagucacuaagaaaacaauuaaggagcugcucaaaaccgaggguuuuaucgaugggaagggagaaauugugggcauagacaacaucguuaaaaaugaucuuaagagcuauagagacuucaagaaaauuuuagcagauaaguuugacaaagagaggguggaaaacaucauccuguggauuacgcuuuacggcgagucucggaaguugauaaaagagaagaucaccaagguauauggggacuucuacacagucgaugaaauugagaaaaugucacgccucacuuacaaggacuggggaauccugaguagaaaacuacugaccgaacucgugagcgagaagcuguauaaugaagagacaggugagugccuuaacauuaucggcgcuaugaggcaggggacuauauuguuuauggaacuguuagccgauaaauucgacuacaugucccagaucaagaaucacaacaaggagaauaaagaugacauuaccgaaaucacacccgauauucucgagaaccugcacgcuucuccugccguuaagcguucgaucuggcagaccgugcggauagucgaggaacuuaaaacuauuaucggaugugugccaacgaagauuuucaucgagacaaccaaacgaaauaacgcacccuauaagguaccuacucugaauagaaacgacuuggugaccaaguacaaaacaauaagggaacaugagaucuuugaacucgagaaggaacugaaaaauacccuagauuucacucugaacaagaaucgccucauuaacgaggagccaagcaaacugaaggccacaaaacuuuauuuguacuauacgcaacugggccggugcauguacaccgguaaaaagaucgacuuaggggaacucuuugauaacaauaacaaauacgacauugaucacaucuauccccaguccaagguuaaagacggcucauucaauaacauaguccuggugacuaaggcuaguaaugacaugaaagcggauguguuuccgcuuaagucuaaguuccagacaaaagagaacaagaucuuuuggagauuccugaaagaaaagaaacuaauuaccgaggagaaguacaauaggcucguccgcacagaagaguuuagcaacggagaacugacuggcuucaucacccgacaauugguugagacgucccaggcaauuaaggugaucucaaaugugcugcgggaauuaaacccugagaccacaauuuguuauagcaaagccgagaauguaucuuccuuucgucagaguuucgggaagauaaaagaagcuaacagaaaggccgagaauaacgaaaaacucaucaggguccaggagauuaaugacuacuauaacgcaaaggaugccuaccugagcaucgugguuggaaacguguaugacgucaaguuuacucgcaaugugcauaacuucauuaaaaauaacaaggaugcucggagauacucucuuaauggucuguucuacaccgacguuaaaaacgccaauacaaucgcaugggaaauggauaagacugugcacguagucgagaaaaccaugaacaauaacaauauauugaucacgaggcgaacauccgagcaaaagggcgcgcucuaugacgcuacccuguacaaggccaaaguggcagaaaaggccaaagaggggacuuauuacccccuaaagacaaccgauucaaaaauuaaggacgugggaaaauauggcgguuuuacuaagaucaagauugcuuacuauaguaucuucgaauacacccuggaugggaaaaagggcaaacagaagauaacacgcauugucccaaucccuaucuacauuagccagaacauaaaagacgacaaggcccuucucgaguaugcacagacgcggcugcccggaaaggauuugaaaaucaaguacagaaaacugugcauuggcucguuaguuaagaucaauaacuuuaauuauuacauugggggaaaaaccaacaauaacuucacuuuugacuccgcugugcaaguaauccucgauaaggacucugaaagcuauauaaaggagcuggccaaauaccuuaacuggaagaaagagaauaaggaugguaaacugugggaaucaaucacagaggacaagaacauucaguuguaugauagucucgugaagaaaaugaauaccggcaucuucauuaggaagacaccaaacaaauacacugaacugcuaacccuggaggucaagaauaaauuuaucaacauagacauugaugaacaggugaaacuucuccuggaaaucuugaauuuacugacgaacaagaaguucacauccaagcucaaugagaucgggauuaccgcgucucguggaguuuguagcuuuaaccuguccaaucagucacaauucagcaucauagaacagagugugacuggcgucuacgagaaagaaaaacuuauuaucgagaagaagaaagaggguauucuguga

SEQ ID NO: 3227 - RNA, 4161 nt, Artificial Sequence
  Cas9 variant
augaaccagaaguacagcaucggccuggacauugggaccaauuccgugggaugggccgucauaacagaugacuauaaaguucccgcuaagaaaaugaaggugcucgguaacacugauaaacaaucuaucaagaagaaucuucugggcgcauuguuauucgacucaggggagacggccgaagcgaccagacugaaaaggacagcucggcgccgauacacucguagaaggaaccggcuacgcuaucuccaggagauuuuugccgaagagaugaugcagguagaugaaaguuucuuucagagacuggacgauagcuuccuuguggacgaggauaagaggggagagcggcacccuaucuuuggcaauauugcagccgaagucaaauaccaugacgaguucccaaccaucuaucaucugcgcaagcacuuggcugauauaucccaaaaagcagaccuccgacugguguaccuggcccucgcucacaugaucaaguuuagaggucauuucuuaauugaagggcagcugaaggccgagaacacaaauguucaggcgcuuuuuaaagauuucguggaggucuaugacaagaccguggaagagucucacuugucggaaaucacuguagacgcacugucaauucuaacagagaaaguuagcaagaguaggcggcucgaaaaccugaucgcccacuacccggcugagaaaaagaauacccuuuuuggaaaccugauagccuuguuccucggccugcagcccaauuuuaaaacgaacuuccaauuauccgaggaugcaaagcugcaguucucuaaggacacuuacgaagaggaucucgaaggccuucugggggaggugggagacgaauaugcugauuuguuugccagcgcgaaaaaucuauacgacgccauucugcucuccgguauccugaccgucgaugacaacucaacaaaggcaccucuuagugcuagcauggugaaacguuaugaggagcaucagaaggaucugaaaaaguucgaagacuuuauuaaggugaaugccuuggaucaguacaacgcuaucuucaaagacaagaacaaaaagggcuaugccggguacaucgagucuggagucaaacaagacgaauuuuauaaguaccucaagggcauucuguuacagauaaaugguuccggggauuuccuggacaaaaucgaucgcgaggacuuucuaagaaagcagaggacuuucgauaacggaucaauuccacaccaaauccaucuccaggaaaugcacgcaauacugcggcgacagggcgagcacuaccccuuucuuaaagagaaucaggacaagauugagaaaaucuugaccuuccgcaucccuuauuacguuggcccacuggccagaaaggggagcagguuugcuugggcggaauauaaggcagaugaaaagauuacacccuggaacuucgacgauauccucgacaaagagaaaagugccgagaaguuuauuacccggaugacgcugaaugaucuuuaccugccugaagagaaaguguugccaaagcauucucuccuguaugaaacuuucacaguauacaacgaguuaaccaaagugaaguaugucaaugaacaaggagaggcuaaguucuuugacgccaacaugaaacaggagauauucgaucacguguuuaaggaaaaucgcaaaguuacuaaggacaaacugcuaaacuaccucaauaaggaguucgaagaguuuagaaucgugaaccugacaggucuugacaaggaaaauaaagucuucaacuccagcuugggcaccuaccaugaucugaggaagauucucaauaaaucguuucuggacaacaaggagaacgcacagaucaucgaggauauuauacagacguuaacccuguucgaagaccgugagaugauccggcaacgacuucagaaauauucugauauuuuuacaaaggcccaguugaagaaacucgaaagaaggcacuacacuggguggggacgccuguccuauaagcuaaucaauggcauucggaacaaagagaauaagaaaaccauccuggacuaccucauagaugacgguuaugcuaacagaaauuucaugcagcugaucaacgaugacgcccuuucauuuaaggaagagauugcaaaggcgcaaaucauuggggauguggacgauaucgcuaauguaguucaugacuugccgggcagucccgccauuaaaaagggaauacugcagagcgugaaaaucgucgacgaguuagugaaggucaugggccacaacccugcaaauauuaucauagaaauggccagggagaaccagacaacugaucgcgggcgacguaauucccagcaacggcucaaacugcuucaggacucucugaagaacuuggauaauccagugaacaucaaaaauguugaaaaccagcaacuccagaacgacagacuguuccuauacuauauucagaauggaaaggauauguacaccggugagacacuggacaucaacaaucucagccaguacgauauugaccacaucauaccccaggcuuauauuaaggaugacucauuugauaacagggugcugaccaguuccagcgagaaucgcggcaaaucugacaacguaccuucaaucgaagucgugugcgcccggaaggcagacuggaugagacuuaggaaagcuggguugaucagucaacgaaaguucgauaaucugacuaaagccgagcgcggaggcuuaacggaaaacgacaaggcggguuucauuaagcggcagcucguugagacaagacagaucaccaaacauguggcccaaguccuggaugcuagguuuaaugcaaagcacgacgaaaacaaaaaggugauucgugauguaaaaauaaucacucuuaagagcaaucuggugucccaguuccgcaaggacuuuaaauucuacaagguucgggagauuaacgauuaucaucacgcccacgacgcuuaccuaaaugccgucaucgggaccgcacuccugaaaaaguauccaaaauuggcgucugaguuuguguacggcgaguucaagaaguaugaugugagaaaauuuauugccaagucggacaaagaaaucggaaaggcuacagccaaauacuucuuuuacagcaaccugaugaauuucuuuaagaaggaagucaaauucgcagauggcaccguuguggagaggcccgacauagaaacuuccgaggauggggagaucgcuuggaacaagcagacagacuucaaaauugugcgaaagguauuaucauauccgcaggucaacaucgugaaaaagacggaaguucaaacccauggacucgaccgggguaaaccucgcggccuguuuaaugccaaccccaguccaaagccuaagcccgauucuagcgagaaucuugugggggucaaaagaaaccuggacccaaagaaauacggaggcuaugcagguauuuccaauucauacgccguguugguuaaggcuaucauagaaaaaggggugaagaagaaagagacuaugguacucgaguuccagggcauuagcauccuggauaggaucacauuugaaaaggacaaacgggcguuccuacugggaaagggcuauaaagauauuaagaagauaaucgagcuucccaaauacucucucuuugaacugaaggacgggucccgaagaauguuggccaguauucugagcaccaacaauaaacgcggagagauccacaagggcaacgaauuauucgucccucagaaauuuacaacucuccuguaucaugcaaagaggauuaauaacccaaucaauaaggaucacauagaguacgugaaaaagcaucgugacgauuucaaagagcuucugaacuacguguuggaauuuaaugagaaguaugucggugcuaccaaaaacggggaacggcucaaggaggccguugccgacuucgauucuaaauccaaugaagagaucuguacgucauuucugggagcugugaacaguaagaaugcaggccuauucgagcugaccagccuugguucggccuccgacuuugaguuccucggcguaaagauuccgagauacagggauuauacacccucuagccuguugaaagacucaacuuuaauccaccaaaguauuaccgggcuguacgaaacacgcaucgaccucuccaagcugggagaagauuga

SEQ ID NO: 3228 - RNA, 4161 nt, Artificial Sequence
  Cas9 variant
augaccaagaucacagaggacuacauugugggccuggauauagggacuaacagcugcggaugggucgccauggacuccaaaaauacgauccucagaaugcacgguaagaccgcuauuggcucucaucuuuucgaugcagggaacucagccgcggacaggcgggcuuuucgcacaacucgacguagaaucaaaaggcggaaguggcgccugaaauuguuagaagagauuuucgauagucaccuggccaagguugaccccuacuuuuucgcaagacuaaaggaaagcggacucuccccucuggauaccaggaaaaaugugucuucgaucauauauccaacaucacuugaggacaagaaauuuuauguagauaacccgaccaucuaccaucugcgguauaaguugaugacugaagaccgcaaauucgaucuccgagagguguaccuggccauucaccauaucgucaaguauagaggcaauuuucuguacaacacacccgugaaggcuuucgaggcaagcaaaauugacguuaaggguagucucaaaaaguuaaaugaacuguacgaggggcuugauuccgaauuuaacguggaguuggacucuaauaacgcccuggagaucgaaaauauaauuagggacaaaaagaucuucaaaauuaacaaggucaaggagaucaaucagcuacucagccugaaaaccgaagauaaggagcggacgaaacuuaugaaggacguguccaaacaaaucguaaacgcuauucugggauauaagacuaaguuugaaaccauauugcucaaagauguuucaaaggacgaggccgaugacugggaguucaaacugacagauguggacgcggauaauaaguuugaaaacuuaaucggcgaccugaacgagaaugaacaggagauucuccuugucauccguaaacuggcaaacgccauaacuuugaguaauauuguggaagagggcaagacccuaagcgagucuaugaaggauaaauacaagaaacacuccgacgaccugaagcuccugaaacaggugaucucagaucacccugaccgcgauaaggcuaagaaacuugcccuggcauaugacuuguacgucaacaauagacaugggaagauccuccaggcuaaagauauucuggaaaagaaaaagacauuaagcaaagaggacuucuauaaggaaaucaagaaaaaccuggaugacaguaaggagucucaagaaauucuagaugccauaucccucgacagcuucaugccaaaacagaggaccaaugagaacggaguuauccccuaccagcugcaccagcuugaguuggauaagauuaucgaaaaucaagguaaauauuacccuuuucugaaggaggugaacccaguaucgucucaucucaagcaggcgcccuacaaacuggacgaacuuauccgguuccgagugccuuauuacgucggcccacugauuuccccgaaugagucaacgaagaacaaacagacuaagaaaaaucagaacuuugccuggaugauacgcaaggagcaagggcagaucacacccuggaauuucgaucagaagguggacagaauggcaagugcuaacaaauuuauuaagaggaugaccacuaucgacacauauuugcucggagaagauguucugccugccaacagcuuacuguaccaaaaauucaccgugcuaaaugagcucaacaaugucaagauuaacggcaaacggaucuccgugccacugaagcaggaacuuuauaauaacuuguuuaagaaaaauucuacgguaaccacaaacaagcugaaaagcuaccucaaggagaauuauaaacugauaaagguugaaaucaaagguuuaucagacgagaagaaguucaacagugggcugacuaccuacaauaaacuuaagaacuugaaaauuuuugaucagcagaucgacgaucccaauuacaacaaggacuucgagcgcauuaucgaaugguccacaauauuugaggauaaagcuauuuauaaggaaaagcucaaaacuaucgacuggcugagcgauagacaaauugacaagcuaucuaaaaucaggaugcagggauggggccagcugucaaagaaacuccugagucagcuuaccgauaauaacggccaaacaauaaucgagcaguugugggacagccagaacaauuucaugcagauugugaaccaagccgauuuuaaggacgcaaucgccgucgcuaaucagaaccuguuaguggacaccuccgucgaagauauucucaaugaggcguacacuucuccugcaaacaagaaagccauccgucaggugguuaaggugguagacgauauagucaaagcuacgucggggaaggugccaaaacagauugccaucgaguucacacgggacgcagaugacaaugccaagaucagccaaucccgagcuaacaagcugagaaaaguuuauaaggaaaugucaaaugagcuugccagugaaaccauuaggaacgagcuggaacgcguggcaaaagaucagaaguugcucaaagacaagcacuaccuguauuucaugcagcuaggacgggaugcguacacuggugagcugaucgacauugauaaucucgagcaauaugacauagaccacguccugccccagucuuuuaucaaggaugacagccuugaaaacagaguguugguaaagaaggcugugaauaacggcaaauccgauaauguuccggucaagcuguacgggaacaggauggccaccgacuuaggaaugacaauucgccauaugugggagaaauggaaggaacagggccucaucaccaaaacuaaguacaacaaucugauuaucgauccugacaagauaaacaaauaugagucaagcgguuucauccaccgacagcuuguggagacaucucaaauuaucaagcugguguccacgauucuacagaguaaauaccccgauaccgaaaucauagucguuaaggcacgguauaaucauuaccuccguaaaagacugaacuuguauaagagcagggaggugaaugacuaccaccaugccauugaugcuuaucugucugccaucugugggaacuuacucuaccagguguacccauaucugcgccccuuuuucguauacggccaguauaagaaauuuuccucagaaccugagaaggagaaaaucauuuacgacaagacucggagauauaauuucauaagucaaaucuuugaaaacaaagauaaugacauuaucagcagggagacaaagaagaaagucuucgauaagaaagacauuaucgaaaaacuuaaacgagcauacaacuauaaguacaugcuggugucgcgcgagaccgaaacacacgaccaggagauguuuaagaugacuguuuacccacgguuguccagagauaccaaaaagucuaggaaucucauacccaaaaagaaagacaugccuacggaaaucuauggaggcuacaccaacaauagcgaugcuuauaugauuaucgcccguauuaacaagaaaaaggggccagaguaccgcguguucggagucccgaugcgggagcuggugaaucuaagaaaggcggagaaaaacggucacuauaaggccuaccugaaacagguucuugaacccgaaaucauguauucaaagaauggcaaaaagaacaagacaauaaguuccuuugagauugugaaagcuaagguaccuuacaaacaggucauccucgacggggauaagaaauucaugcuggcaucuagcacuuacgugcaaaacgccaagcaguugacccugucccaguauucaaugcaagcuaucacagacaauugcgaaaacgauacugaggaggaaaaggccuuaguggaggcauacgacgaaauucucaccaauaucgauaaauaucugccacuuuuugacauaaacaaguucagggagaaacugcaugcgggacgagagaaguucgucgauuugccccucgccgagaaaaaggaaacgauucugcagguucuaaauggccugcacgacaacgcugugaugccuaagaucaaaagccuuggucucaguacaccacugggguuuaugcaguuccauaccggcguaucuuuguccgaaaaugccaaguuaauuuaccagagccccacuggacuguuugagaaacggcucaagaucucggaucuguga

SEQ ID NO: 3229 - RNA, 4164 nt, Artificial Sequence
  Cas9 variant
augagcgacuccaagaaauucgagggcgaaaacgugaagucuggggauaaaaagaccaauaaaaaccacggaaagguccugaagucaagucccaaagagaucagaaagaauacagaauacuuuauuggucucgacauaggcacuagcuccguugggugggccgugacgaacaccgauuaugagauccuuaaauucaauggaaagaggauguggggcucucggcuguuuaacgaagcaucgacagcugaggagcgccgaggucaucguguaaauagaaggcggauucagcgcagaagggaccgguugaacuuacuggaagagaucuucucagaagagauggccaaaguggauccugaguuuuucaugcgccuaaaggaaagcaaguuucaccucgaggacaaagaugaacgaauccugggggagaguaauauuauauucaagggauccgaagacggcgauaaaaaguacuaugagaaauacccaacuaucuaucaucuuagacacaagcugaugcaaucuugcgaggacgucgauauuagggaauuguacauggcgcuccaucacaucauuaaauaucggggccacuuucuguucaagggggacuuugaggaaaccggaacaagcaucgagaacauaauuaucgaacugcucgaguuaauuaauaacaaucugggugugaagaaauucgaguacaacgaaucccuuaucaaugaguugaagaacaucguuucaaacaccaguaauacuauuacaaacaaaaagaaacugcuaggcgaauuuuucaauaagaaggaguacaaagcucauaagagccucuucauacugucuaucggggccuccgugaaaccggucgaucuuuuucuggaagaggaguauaaggacauugacgauaucaaaaacauaucauucaagaauuuggaauacgaccaggugcgugauaccuaugagagcauuuuucucgacaagaucgaguucaucgauguagcaaaacgccuguacgacgccacgauuuuacugaguaucaagcccgaaggaaaaacucucucugaggcuaagguugauauuuauaacaaacaccauaaugaccuugaacuguugaagaaggugcuaaaaaccgauaaggagaaauacgacuccauacugaagcucgauaucaaaaagggcaacaauuaugucaacuacgugaaaaagagcaagaaugguauuucguguucuaaagaagaguuucacaacgcacugaagaaagugcuugucaagaucgaaaagacagacgacaucaaguacauucugaaugagauagaguuggaaagauuccucccucugcagaggguuaaggauaacuccgugaucccauaucagauucaccgguacgagcugaaaaagauccuggaaaaugccaguaaaaaguuuacuuuccuaaacgaggaaucagacgggcauaccaacauugagaaaaucauaaagaucauggaguaucgcauucccuacuauguaggaccucucaaugaucaccauagcguguacaacaauggcuuugcuugggucucccgaaagagaucuggcaggaucacaccauggaacuucgacgaaaugguggauaaagaggaaagcgccgagcgguuuauugaaaaucugaccaacaagugcucauaucuuaucggggaggacguuuugcccaaagagagucugcucuacuccgaguucagccugcuuaaugaacugaacaauauaaaguacgauggaauuucuuugccuaucgacauuaaaaagucaaucguggaaaagauauuucgcgucgagaaaaagagagugacgaaaaaguauaucaaagaguuccucaagcaagaagguuacagugauggcaaaggggagguaagcggaauugacaucgauauuaaguccgaccugaagucuuauagggauaugguuaaaaucuucggcacugaaauagacuaccguauggcggagaacauuaucaagugggugacauuauuuggugacucgaaagaucugcuaaagaccaaaaucaauaaggaauauggggagaaggucagcaaagaccagcucaagaaaguguguaagcugaaauaccgggauuggggccgacuuuccaagaaguucuugacuggaauuagaucaaguguccuggugaacgacgcaacaggcgagggguauaccaucauugaagccaugaggaauacggauaacaaucucaugcagcuguuacgcaacgaguacgacuaccugaaaaagauagaucagaucaacaugcuuucucggaaagacauugaugaaaucagccacgacauuuuggaugaccucuauugcuccccagcuguuaagagaucacuguggcaaaccaucaaaauaguggaggaaaucaagaagauuaugggacaugagccgaaaaagguauuugucgaggugacaaggacuaauaaagccgauaagaaaaccacaaucacucgcaagaaccgacuacuggaacucuacagcgcaauuaaugcugagucucgggacuggguuaacgaauuaaauuccaccgaggugaguaaguucaacagcaaaaaguuguaucuuuacuauacacagauggguaaauguauguacaccggcaagaauaucgacauagaaucucuguuuacugauauguaugacauugaucacaucuucccccguuccaaaacgaaggacaacucauuugagaauuuaguccucgugacaagaaaagccaacgcggauaagagggacguauacccuaucgauccaaagauucagaccgagcgcaaaagucugugggacaugcuucacgauaagaaacugauaggggacaagaaauacgaucgguugacuagaaccacaggauucaccgacgacgaaaugagcggcuuuaucgccaggcagcucguggagacuucgcaagcauccaaggcugccgcugaaaugcugaagcuaauuaauaacgauucugagaucguuuaugucaaagccgagaaugugagcgacuuccgacaugaaaacgaguuuauuaaggugcgcgaaaucaaugaucaccaucacgcaaaagacgccuaccugaacauagucguugguaacguguauaaugagaaguucacgaaaaaccccgcuaauuacaucaagaaagggggcggaaacaauuauucacucaacugcauuuuuaaucggaaccuggauagaaauggcaaaaggaucugggacgaaaagaaaaguauugauacagugaaccguaugaugaaguccaaugacguacgcgucaccuucaaaaaccggguggauaaggggccuauccuuaauaagguuacuauacacaaagcgucugaguucauggacgauggaaagaaaaacaagaaagguuuuccaauuaagagcuccgagaaaaauggcaacaauagauuguguaaccuguacaaguaugggggauacaaggacuuaaacuacucacauuauacaaucgugagguacaaugucuaugagaaaaagggccucgauaucaaauacuauaugauucccaucccguacuaucugugccuuuguaacauaaaucagcacgacuacguguacgacuauauuagcaaccgaaguaagaaagauguuaauaacaucgaaauuaucgugaaugaacugaagauggguucucuaauaaacauugacggguacaauuauuaccucggcggauccaagccuaaaaccuucuauguagaucccgcauaccagaucauccuggacaaggagauugaacggugcaucaaagagauugucaaggccaaaaacaaugaguaucgcuuuauaaacacagauaagaucaauaagaacuugaauaugaaaauuuacaaguacaucgugaacaaaaagaucauuggcguguucagaaacaggaaaugggacaagggggaauaucugaauagcucggagacuauagaaaaguuuucaggauuaucugucgagagucaauguaacguuauccuccggcugauuaaugauaugcgaggcuccaacaaagguggggcuaauagcaaguucgacgaacuugagaugaccaucucuagagccgagauuccacagacgcugagcaacguguccucauuuaaaaucauaaaucagaguaucaccggauuguucgaaaacgagguaacaauuguguga

SEQ ID NO: 3230 - RNA, 4167 nt, Artificial Sequence
  Cas9 variant
augaccaagcccuacagcaucggccuggacauugggacaaacuccgugggaugggccgucauaacugaugacuauaaaguuccuucuaagaaaaugaaggugcucgguaauacgaguaaaaaguacaucaagaaaaaccuucugggcgcuuuguuauucgauucagggauuaccgcagagggaagaaggcugaagcggacagcccgccgacguuauacuagaaggcggaaucgcauccuauaccuccaggaaauuuuuagcaccgagauggcgacacuggacgaugcuuucuuucaaagacuugacgauuccuuccugguaccagacgauaaaagggacucuaaguauccgaucuuuggcaacuugguggaagagaaagccuaccacgaugaguuccccaccauauaucaucuccggaaguaccuggcagacucgacuaagaaagccgaucugcgccucgucuacuuagcucuggcacacaugaucaaguaucgaggucauuuucuuauugaaggggaguucaauagcaaaaacaaugacauccagaagaacuuucaggacuucuuggauacauacaaugccauuuuugaaucagaccugagucuagagaacuccaaacagcucgaagagaucgugaaggauaaaauaucuaagcuggagaagaaagacaggauucuuaagcuguucccuggagaaaagaauagcggcaucuuuuccgaguucuugaaacucauuguuggcaaccaagcugauuucaaaaaguauuuuaaucuggacgaaaaggccucauuacacuucaguaaagagagcuacgaugaagaccuggagacccuccuuggguauaucggagaugacuacucugauguguuucugaaggcgaaaaaguuguaugacgcaauccuacuguccgguauucucacggucacugacaacggcaccgaggccccacugucaagcgcuaugauaaugagguacaaagaacaugaggaagaucuugggcuguugaaggccuacauccggaauauuagucucgagacauauaacgaaguguucaaggacaacucuaaaaauggauacgcaggcuauaucgaugguaagacuaaccaggaggacuuuuacguauaucugaaaaauuuacuguccaacuucgagggggcugauuacuuucuagaaaagauagaccgugaggauuuccuccgcaaacagagaaccuuugacaauggaagcauucccuaucagauccaucugcaagaaaugagggccaucauugauaagcaggcgaaguucuacccuuuucuugccaacaauaaagagcggaucgaaaagauuuugacauuccgaauaccauacuauguuggcccccuggcacgcggcaacucggacuuugcuuggucuaucagaaaaaggaaugagaagauuaccccuuggaacuucgaggaugugaucgacaaagaauccucagccgaggcuuucaucaaucggaugacgaguuuugaucucuaccugccagaagagaagguccuuccgaaacacagccuguuguaugagacuuucaacguguacaaugaacucacaaaggugcgcuuuauugccgaguccaugucuaaguaucaguuccuggacagcaaacagaagaaagacauagucagauuauacuuuaaggauaaaaggaagguuaccgacaaggauaucauugaauaucugcacgcaaucgacggguacgauggaauugagcuaaaagguaucgaaaagcaauucaacucaagucucuccacuuaccacgaccugcuuaauauaaucaacgauaaagaguuuuuggacgauagcucuaacgaggccauuaucgaagagauuauccauacacugaccauauucgaagaccgugagaugauuaagcagcggcucucaaaauuugaaaauaucuucgauaagagugugcugaagaaauuaagccgaagacacuauacgggcugggggaagcuguccgcuaaacuuauuaacggaaucagggacgagaagucuggcaauaccauauuggauuaccucaucgacgacgguauuucgaaccgcaauuuuaugcagcugauccacgaugacgcgcugagcuucaaaaagaagauucaaaaagcacagaucauaggggaugaggacaagggcaacauuaaagaaguagugaagucccugcccggaaguccugccaucaaaaagggcauccuccagucaauuaaaaucgucgaugagcuggugaagguuaugggagggcggaagccagaaucuauuguggucgagauggcuagagaaaaucaguauacaaaccaagguaaaagcaauucccagcagaggcuuaagcgcuuggagaaaucacugaaggaguuaggcagcaaaauacucaaggaaaacauccccgccaagcugucuaaaauugacaauaacgcacuucagaaugaucgacuguacuuguauuaccuccaaaacgggaaggacauguauacuggagaugaccuggauaucgaccggcuauccaauuacgacauugaucauaucauaccucaggccuuucugaaagacaacaguaucgauaacaaggugcucguaagcucugcuuccaaucguggcaaaucagacgauguuccaagucuggagguggucaagaagagaaaaacccuuugguaccaguugcuaaagagcaaauuaauuucgcagaggaaguucgacaaccucacaaaagccgaacgcggugggcugucccgggaggauaaggcaucuuucauccaaagacagcuuguggagacuaggcagauuaccaagcacgucgcgcgacugcuagacgaaaaauuuaauaacaagaaagaugagaauaaccgcgcugugcggacaguuaagaucauaacccucaaaagcacucuggugucacaguucagaaaggacuuugaauuguauaagguaagggagauuaaugaucugcaucacgcccaugacgcauacuuaaacgccgucguggcuagugcccuccugaaaaaguaucccaaacuugaaccggaguucguuuacggcgauuauccuaaguacaauuccuuucgugagcgcaaaucugcaacggaaaagguguauuucuacagcaacaucaugaauaucuuuaaaaaguccauuucacuggcugacggaacagucauagagaagcccuugaucgaagugaacgaggaaaccggcgagagcguauggaauaaagagagugaccucgccacugugcggagaguucugucuuacccacaagucaacguggugaagaaagucgaaaagcagaaucacgggcuagauaggggaaaaccuaagggucuguucaacgcgaaccuuuccagcaagcccaaaccaaauucgaacgagaaucucguuggcgccaaggaauaucuggaccccaaaaaguacgggggauaugcuggcauuucaaacucuuuugcaguguuggugaaagguaccaucgagaagggggccaagaaaaagauuacaaauguacuggaguuccagggcaucaguauauuagaucgaaucaacuaccggaaagacaagcucaauuuucugcuugaaaaaggauauaaggauauugagcugaucauugaauugccuaaguacucccucuucgagcugagcgacggcucucgcagaaugcuagcuagcauccuguccaccaacaauaaaagaggggaaauacacaagggaaaccaaauuuuccuuucacagaaauuugucaagcuccuguaucaugccaaacggaucaguaauacuaucaacgagaaucaccgaaaguacguggagaaccauaaaaaggaguucgaagaauuguuuuacuauauuuuagaguucaaugaaaacuacguuggcgcaaagaaaaaugguaagcugcucaacagcgcguuucagucuuggcagaaccacuccaucgaugagcugugcucaaguuucauagggccaacaggaagcgagagaaaaggccuuuuugaacugacgucccgcgguucugccgcugacuucgaguuuuugggcgugaagauuccgagguaucgugauuacacccccucgagccuacugaaagacgccacucucauccaccaaucagucacagggcuguaugaaacccggauugaucuugcaaaguuaggagagggcuga

SEQ ID NO: 3231 - RNA, 4167 nt, Artificial Sequence
  Cas9 variant
augaccaagcccuacagcaucggccuggacauugggacaaacuccgugggaugggccgucauaacugauaauuauaaaguuccuucuaagaaaaugaaggugcucgguaacacgaguaaaaaguacaucaagaaaaaucuucugggcguauuguuauucgacucagggauuaccgcugagggaagaaggcugaagcggacagcacgccgacguuauacuagaaggcggaaccgcauccuauaccuccaggaaauuuuuagcaccgagauggccacacuggaugacgcguucuuucaaagacuugaugacuccuuccuggugccagaugacaaaagggauucuaaguauccgaucuuuggcaauuuggucgaagagaaaguguaccacgacgaguuccccaccauauaucaucuccggaaguaccuggcugauucgacuaagaaagccgaccugcgccucguuuacuuagcacuggcccacaugaucaaguaucgaggucauuuucuuauugagggggaguucaacagcaaaaauaacgauauccagaagaauuuucaggacuucuuggacacauacaacgcuauuuuugaaucagaucugagucuagaaaauuccaaacagcucgaagagaucgugaaggacaaaauaucuaagcuggagaagaaagauagaauuuuaaagcuguucccuggagaaaagaacagcggcaucuuuuccgaguucuugaagcucauugucggcaaucaagcagacuucaggaaaugcuuuaaccuggaugaaaaggccucauuacacuucaguaaggagagcuaugacgaagaucuggagacccuccuuggguacaucggagacgauuauucugacguguuucugaaagcuaagaaauuguacgaugccauccuacuguccgguuuccucacgguaacugacaaugagaccgaagcgccacugucaagcgcaaugauuaagcgguauaacgagcauaaagaagaccuugcccuguugaaggaguacauacguaacaucagucucaagacauacaaugaaguuuuuaaagaugacacuaagaacggcuaugcuggguacauugauggaaaaaccaaucaggaggacuucuauguguaccugaagaacuuacuggccgaguuugaaggcgcagauuauuuccuagagaaaaucgaccgcgaagauuuucucagaaagcagaggacauucgacaaugguucuauacccuaccagauucaucugcaagagaugcgggcuauccuugauaagcaggccaaauuuuauccuuucuuggcgaagaacaaagaacgaaucgagaagauucugaccuuucgcaucccauacuacgucgggccccucgccagaggaaauuccgacuucgcauggagcauuaggaaacggaacgagaagauaacgccuuggaauuucgaagaugugaucgacaaagagucgucugcugaagccuuuauuaaccgcaugacuuccuucgaucuguaucuuccagaggagaaggugcugccgaagcacucauugcucuacgaaacauuuaaugucuauaacgagcugaccaaaguuagauucaucgcugaaaguaugagggacuaccaguuuuuagacagcaagcagaaaaaggauaucgugcgucuguauuucaaagacaagcggaagguaacugauaaagacauuauagaguaccuacacgccaucuauggcuacgauggcauugaacucaaggggaucgagaaacaauuuaauuccucucugagcacauaccacgaccuuuugaacauuaucaaugauaaggaguuccuggacgauucaaguaacgaagcaauaaucgaggaaauuauccauacccucacgauuuuugaggaccgagaaaugaucaaacagagacuguccaaguucgagaacauauuugauaagagcgugcuuaaaaagcugucuaggcgccacuauaccggaugggguaaacuuucagccaaguugauuaauggcauccgggacgagaaaagugggaacacaauucucgauuaccugaucgacgacggaauaagcaauagaaacuucaugcagcuaauccacgaugacgcucuguccuuuaagaagaaaauucaaaaggcgcagaucauuggcgaugaagacaaagguaauaucaaggaggucgugaaaucucuccccgggucgccugcaauaaagaaaggcauucugcagagcaucaagaucguugaugaacuugugaaggucaugggaggcaggaaaccagaguccauugugguagaaauggcccgcgagaaccaguauacuaaucaagggaagucaaacagucagcagcgauugaaacggcuggagaagucuuuaaaagaacucggaagcaagauccugaaggagaauauucccgcuaaacuuuccaagauagacaacaaugcccugcagaacgaucguuuguaccucuauuaccugcaaaaugguaaagacauguauaccggcgaugaccuagauaucgacagacugucaaacuacgacauugaucauaucauuccucaggcauuccucaaggacaauagcaucgauaacaaaguucuggugucuuccgccaguaacaggggaaagagcgacgauuucccaucucuugaagucgugaagaaacgcaagacauuuugguaccaguugcugaaauccaaguuaauaucacagcggaaauucgacaaucucacuaaggcugagagagggggccugcuucccgaggauaaggccgguuuuauccaaaggcagcuggucgaaacccgacagauuacaaaacacguggcacgccuacucgacgagaaguucaacaauaaaaaggaugaaaacaaucgggcgguuagaaccgugaaaaucauuacucugaagaguacguugguaagccaguuuaggaaggacuucgagcuguauaaaguccgugaaaucaacgauuuucaucacgcucaugacgccuacuuaaaugcagugauagccucggcucuccugaagaaauauccgaaacuugagccugaguucguuuacggggauuaucccaaauacaacuccuuucgcgaacggaagucugccacagagaaaguguauuucuacagcaauauuaugaacaucuuuaagaagucaaucagucuggcagacggcagagucauugaaaggccauugauagaggugaaugaagagaccggagaguccguauggaacaaagaaucugaccucgcuacugugcgacggguucugagcuacccucaagucaauguggugaagaaagucgaggaacagaaccacggccuagaucgcgggaagcccaaaggacuguucaaugccaaccuuuccucaaagccaaagcccaacagcaaugagaaccucguuggugcgaaagaauaucuggacccuaagaaauacggcggguaugccggaaucaguaauucuuucgcuguguuggugaagggcaccauugagaaaggugcaaagaagaaaaucacaaacguacuggaguuucaggggauuuccaucuuagauagaauaaauuacaggaaggacaaacucaacuuccugcuugaaaagggcuauaaagauaucgagcugauuaucgaauugccaaaguacagccucuuugagcugucggacggaucacggcgaaugcuagccucuauucugaguaccaauaacaagagaggcgagauccacaaagggaaucaaauauuccuuucccagaaguuugucaaacuccuguaucaugcuaagcgcauuagcaacacuaucaaugaaaaccacaggaaauacguggagaaucauaagaaagaguucgaagaauuguuuuacuauaucuuagaguucaacgagaauuacguuggagccaagaagaacggcaaacugcucaauucugcauuucagagcuggcagaaccacuccauugaugaacuguguucaaguuucaucgguccgacagggagcgagcguaagggacuuuuugaacugacgucucggggcuccgcggccgacuucgaguuuuugggugugaaaauacccagauauagggauuacaccccuucaagucuacugaaggacgcuacucucauucaccaaagcgucacaggccuguaugaaacccgcaucgaucuugccaaauuaggggagggauga

SEQ ID NO: 3232 - RNA, 4167 nt, Artificial Sequence
  Cas9 variant
augaccaagcccuacagcaucggccuggacauugggacaaacuccgugggaugggccgucauaacugauaauuauaaaguuccuucuaagaaaaugaaggugcucgguaacacgaguaaaaaguacaucaagaaaaaucuucugggcguauuguuauucgacucagggauuaccgcugagggaagaaggcugaagcggacagcacgccgacguuauacuagaaggcggaaccgcauccuauaccuccaggaaauuuuuagcaccgagauggccacacuggaugacgcguucuuucaaagacuugaugacuccuuccuggugccagaugacaaaagggauucuaaguauccgaucuuuggcaauuuggucgaagagaaggcuuaccacgacgaguuccccaccauauaucaucuccggaaguaccuggccgauucgacuaagaaagcagaccugcgccucguguacuuagcccuggcucacaugaucaaguaucgaggucauuuucuuauugagggggaguucaacagcaaaaauaacgauauccagaagaauuuucaggacuucuuggacacauacaacgcaauuuuugaaucagaucugagucuagaaaauuccaaacagcucgaagagaucguuaaggacaaaauaucuaagcuggagaagaaagauaggauucuuaagcuguucccuggagaaaagaacagcggcaucuuuuccgaguucuugaaacucauugugggcaaucaagccgacuucagaaaaugcuuuaaccuggaugaaaaggcuucauuacacuucaguaaggagagcuaugacgaagaucuggagacccuccuuggguacaucggagacgauuauucugacgucuuuaucaaagccaagaaacuguacgaugcgauuuugcuauccgguuuccugacggugacugacaaugagaccgaagcaccacucucaagcgccaugauaaagcgguauaacgagcauaaagaagaccuggcccuucugaaggaguacauccguaacauuaguuugaagacauacaaugaaguauuuaaagaugacacuaagaacggcuaugcuggguacaucgauggaaaaaccaaucaggaggacuucuauguuuaccucaagaaccuguuagcagaguuugaaggcgcugauuauuuccuggagaaaauagaccgcgaagauuuucuaagaaagcagaggacauucgacaaugguucuauucccuaccagauccaccuccaagagaugcgggccauccuggauaagcaggcgaaauuuuauccuuuccuugccaagaacaaagaacgaauugagaagaucuugaccuuucgcauuccauacuacguggggccccuggcaagaggaaauuccgacuucgcuuggagcauaaggaaacggaacgagaagaucacgccuuggaauuucgaagaugucauugacaaagagucgucugccgaggcuuuuaucaaccgcaugacuuccuucgaucucuaucugccagaagagaaggugcuuccgaagcacucacuguuguacgaaacauuuaauguguauaacgagcucaccaaagucagauucaucgccgaaaguaugagggacuaccaguuucuggacagcaagcagaaaaaggauauuguucguuuauauuucaaagacaagcggaaggugacugauaaagacauaaucgaguaccugcaugcaauuuauggcuacgauggcaucgaacuaaaggggauugagaaacaauuuaauuccucucucagcacauaccacgaccugcuuaacaucauaaaugauaaggaguucuuggacgauucaaguaacgaagccaucauugaggaaaucauucauacccugacgaucuuugaggaccgagaaaugauaaaacagagacucuccaaguucgagaacauuuuugauaagagcguacugaaaaaguuaucuaggcgccacuauaccggaugggguaaacugucagcuaaacuuaucaauggcauucgggacgagaaaagugggaacacaaucuuggauuaccucauagacgacggaaucagcaauagaaacuucaugcagcugauucacgaugacgcgcuauccuuuaagaagaaaauccaaaaggcacagauuaucggcgaugaagacaaagguaauauaaaggagguggucaaaucucugcccgggucgccugccauuaagaaaggcauccuccagagcaucaagauuguggaugaacugguuaaggugaugggaggcaggaaaccagaguccaucgucguggaaauggcucgcgagaaccaguauacuaaucaagggaagucaaacagucagcagcgacuuaaacgguuggagaagucucugaaagaauuaggaagcaagauucucaaggagaauauacccgccaaacuguccaagaucgacaacaaugcacuucagaacgaucgucuguacuuguauuaccuccaaaaugguaaagacauguauaccggcgaugaccuggauauugacagacuaucaaacuacgacaucgaucauauuaucccucaggccuuccugaaggacaauagcauagauaacaaaguacucguuucuuccgcuaguaacaggggaaagagcgacgauuucccaucucuggaaguggucaagaaacgcaagacauuuugguaccagcuuuugaaauccaagcugaucucacagcggaaauucgacaauuuaacuaaggccgagagagggggccuccugcccgaggauaaggcagguuuuauucaaaggcagcuuguggaaacccgacagaucacaaaacacgucgcgcgccugcuagacgagaaguucaacaauaaaaaggaugaaaacaaucgggcugugagaaccguuaaaauuaucacucucaagaguacgcuggugagccaguuuaggaaggacuucgaguuguauaaaguacgugaaauaaacgauuuucaucacgcccaugacgcauaccugaaugccgucauugcuucggccuuacucaagaaauauccgaagcuggagccugaguucguguacggggauuaucccaaauacaacuccuuucgcgaacggaagucugcaacagagaaaguuuauuucuacagcaauaucaugaacaucuuuaagaagucaauuagucuugcugacggcagagugauagaaaggccacugaucgaggucaaugaagagaccggagaguccguguggaacaaagaaucugacuuggccacuguacgacgggugcucagcuacccucaaguuaaugucgugaagaaaguggaggaacagaaccacggccuggaucgcgggaagcccaaaggacuauucaaugcgaaccuguccucaaagccaaagcccaacagcaaugagaaccuugucggugccaaagaauaucucgacccuaagaaauacggcggguaugcuggaauuaguaauucuuucgcaguucuggugaagggcaccaucgagaaaggugccaagaagaaaauuacaaacguguuggaguuucaggggaucuccauacuggauagaaucaauuacaggaaggacaaauuaaacuuccuccuggaaaagggcuauaaagauauugagcuuaucauugaacugccaaaguacagcuuguuugagcucucggacggaucacggcgaaugcuggcuucuauccuaaguaccaauaacaagagaggcgagauacacaaagggaaucaaauuuuccugucccagaaguuuguaaaacuucucuaucaugccaagcgcaucagcaacacuaucaaugaaaaccacaggaaauacgucgagaaucauaagaaagaguucgaagaacuguuuuacuauauuuuggaguucaacgagaauuacgugggagcaaagaagaacggcaaauuacucaauucugcguuucagagcuggcagaaccacuccaucgaugaacuguguucaaguuucauagguccgacagggagcgagcguaagggacuguuugaacuuacgucucggggcuccgccgcugacuucgaguuucuggguguuaaaauucaaagauauagggauuacacccccucaaguuugcuaaaggacgccacucugauccaccagagcgugacaggccucuaugaaacccgcauugaucuggcaaaacuuggggagggauga

SEQ ID NO: 3233 - RNA, 4167 nt, Artificial Sequence
  Cas9 variant
augaagagaauccugggccucgaccuugggaccaacagcauuggaugggcccuggugaaugaggcugaaaacgagaaagaaauauccaagaucauuaaauugggugucaggguuaaucccuuaacaaucgaugagaagacuaacuucgaaaaaggccggccucugucuacgaaugcagaccgcacccuaaagcgaggggcccguagaaaccuccagagguacaagcugcggcgcgagaaucuuauugagauccugauagauaaccacaucauuacaaaagaaacuccauugaccgagaucggaaagggcacaaccuaucaaacucucucacugagagcgaaagcugugagggaacggauugaccuggaggauuuugccaagguacucuuagcaaucaauaaaaagcgcgguuacaagaguagccgaaaagccuccaacgacgaggaagggcaggcuauagauggaauggcaauugccaaggagcuguaugaaagaggcaucacaccgggccaguacgugcuugaguugcuggaaaaugacaggaaauauauucccgauuucuaccggucugaccuaaagcaggaguuuaacaaaaucuggaauaaccaaaagaccuucuauccugagauccucacggaugaacuguuuaaagagcuugacgggaagaauaagucgcagacuugggcuauuugccagaaaccauucaacauaaagggaaucaaacguauuaccaagggucgcgaaaagacaaucgagaacuaccauuggagagucaagggccugucagggaaguugaaucucgaaaaacuggccauaauuuuacaggagaucaacaaugauaucaaccaaagcaguggauaccugggcgguauuuccgacaagucuaaaaagcucuaucuuaauaaagagacugugggggaauuucuguacaagcagaucgcgaagaacccccacaccagcuugaaaaaucagguuuucuauaggcaugacuaccuagaugaguuugaacagauuuggaagacacaauccaacuucaaugcaaaccugaccgacgagcucaaacaggaaauacgggaugugaucaucuuuuaucagcgaaagauuaaaucacaaaagagucugaucagcuucugucaguuugagucuugggagcaggaauacuucgacaaggagacgggaaaaacuaagacacgcaccgucggcagaagggugauuccuaaauccucaccacuuuuccaggaauuuaagauauggcaaaaucugaaccacuugguauucacuaauagcgagacagaugagaaaaucgaaauuaaggagguugaacaggagauccggaaagaacucuuugaggagcugaacuuacgcggcgaccugaaucccaacgaucuacucaagauucugagaagucaguucaagaucgggaaacuuucuaacuggaagugcaauuuugagaaaauagaaggaaacaggaccaaugccgcuuuguucaacaucuaucagaagauuuccgacuuugaagguuacggcaucgauuggaauaaaagcaacgccaagaagauucguaaagagcugaaggcaacguucccugaaaucgggauagacgcuucgauucucgaguuugaugccuacaaaaagcaacugaccaaucagucuuccuaugagcuuuggcaucuguuguacucagcggaagaggacuucaaaaucagugaacaggacaagcucauuuauggaaacagcuccgugucucugaagaaaaaguuacaccugaaauuuggcuucaauccagaguacgccaagaugcuagcaaaccucagccugaugucagauuaugguaaucuuagugcuaaagccaucaagaagauauugccguaccuggaagacgggcaccucuauuccgaggcuugucggcuggccggcuacaaccauagcaaaucuuuaacagcagaggaacuggagaaguuugaacccaaagccaaacuugauuugcucaaaaagaacucacugcgaaauccugucguggagaaaauccuaaaucagauggugaacgucguuaaccaagugauugacacuuacggaaagccagauggcguaagaaucgagcuggcuagggaacucaagaaaagugcgaaggagcgcgcagaaaugaccaaagggauugccgacggaacacggagaaaugaggaaaucaagaaaauaauuacucagaaguucgguauccccaacccuaccaagagcgaucuggugagguaucgccuuuggcaggaguuggagucccgaggcuacaaagacaucuucacagauaaguauauuucuccagacaaaaucuuuucgagcgaaauugauauagagcacaucauucccaaggcucuguuauucgacgauuccuuuucaaauaaaacccucaguuuccggaacgucaaucugaagaaggccaaccguacugcacuugacuuuaucacgcaggacuaccaaucuaauguggaagccuauaaagagagaguugaaacauggaacaaggauaaucauauuagcaaagggaagaggaacaaacuguugaugucccucaaggacaucccggauggauucauagagcgcgaccugagaaauucacaguacaucgcuagaaaggccaaaaggaugcuauaugagguguuuccuaacgaaguccuggcaaccagcggcucuauuacugauaagcuccgauccgacugggaucugaucaaugugaugaaagagcuuaacuugcccaaguacaaagcgcuggguuuaaccgaauacgaggaacgccucgacaaggggacagaggagcuguucaagcacgaaguaauuaaagauuggaccaagcggaaugaccacagacaucacgcuauggaugcccuugcaguugccuuuacuacacauaaccacauccaguauauaaacaaucugaacgcuaggaaagacauuacgcaagauaaucauccaaucaucaagaacauugagaaucuaauaaccgaagugaacaguaaaggcaagcgugucuucaaagccccuaugagcucuuuucgcgaguccgcaaaggagcagaucgaagcuauucucgugucauucaagaauaaaaacaaggucgugacuaaaaauaucaaccagacaaagaaagagggaggcuuuaauuaccagaacgccaagacaccccgggggcaacugcacaaggaaaccauuuauggaaaaaguaagcagccauuggagaaacccguuaagaucaauaacagauucugcaaaaagcaagugggucugauaaucaauuucaaggaacaggaggcgguauuacaccaucucaaaaaguacgacaacaaugagaaaauugccuuuagcaacaagacucugaaaucggacccuauccaggucaacggcuccccacuuagggaagugaagauuuucgaggaaaucuuuaccauacgaaaggauauuaauccggacaacuucaaaacgcagaagcaccuggauaaaaucaucgacaaggggauuaaagagguuaugaagaaacgguuggaagaguauaauggagauuuuaagaccgcuuucucugaccucgauaagaaccccaucuggcugaaucagagcaaaggcauaacaauuaagcgcgcaacuaucucaggugugaccaacgccgagccucuacaucaggcuaaagaccaccuggggaauauuauccuugaugacaacggcaaggaaauaccaauugauuacgucaguacaggaaauaaccaccauguggccaucuaucaagacgaguccggcaaucuccaggaagagguagugucuuuuuacgaagcaguuauccggaaaaaccaggaccaacccauuaucaagaagaggcacccuaaaggguggaaguuccuguuuacuaugaaacagaaugagauguucgucuuuagcuccgagaacuucaauccaucagaaauugauuugcuggacgagaagaacgcggccauaaucagccccaacuuauuccgggugcagaaaauugcuaccaagaauuacauguuucgacaucaccucgaaacggaggugacaaacaaucuggauuucaccuauagacauuuucaggccacugaguggcuucgcaaccuguguaaggucaggaucgaccacaucggacguauuguucaaauaggcgaauacuga

SEQ ID NO: 3234 - RNA, 4170 nt, Artificial Sequence
  Cas9 variant
augaucauuagaaccuacgagcugaagacaauaacuacgaucgccauucucaaaauguuccagcuucugaccggcggguugagcaugacaaaguuaggaaaacccuaugguaucggcguggacauuggguccaacucuaucggauuugcugcagucgaugaaaauucacaccugauaaggcuaaagggcaaaacuguuaucggugccagacucuucgaggaagggaaggcggcugccgaccgccgagcaagucguaccacaagaaggcggcugagccgcaacagauggaggcuuuccuuucugcgggauuucuuugagucucauauuaccccuacuggaccaaauuucuuuaugcgccaaaaguacucggaaaucucaccgaaagacaaggcccgauauaaauacgagaagagauuguucaacgauaggacagacgcugaguuuuaucagcaguaccccaccauguaucaccuccggaaucgucugcugacggauccuagcaaagcagacgugcgcgaaauuuacuucgccauccaucacauacucaagaguagaggccauuucuuaacuuccggcuacgcuaaggauuucaacaccaauaaaguagcccugaacgagauuuuuccagcgcuucaggacgcauaugcccaaguguaccccgauuuggacaucacauucgaugaaaauaaggucaacgaguucaaaacugugcugcuaaaugagaaggcuaccccuucugacacacagagggcccucguuaaccugcuucuggcagaagacggggauaaagacauuuugaagcagcagaaacaagugcucaccgaguuugcuaaggccgucgugggacugaagacgaaauuaaauguagcgcuggguacugaaguugauagcuccgaggccacaguguggaacuucucacucggccagcuugacgauaagugggcagggaucgaaagugcuaugaccgacgagggaacugagauccuggaucagauucgggacuuguaucgagcccgccuacugaauggcauagucccagcugguaaaacacucagccaggccaagguggaugacuacgcacaacaccacgaagaucuggagcuuuuuaaagacuaucugaagcaguuggaagacgaugggaccgccaaggcuaucagacagcucuacgacagguauauugauggagacgaugcgaaacccuucgugcgggaggacuuugucaaggcacugacgaaagaaguuaccgcccauccuaacgcuaagucuccagaguuacuggagcgccuagcccaaccggauuucaugcucaaacagagaaacaaggcaaauggcgccauccccgugcagaugcagcaaagggaacuggaccagauaauuaagaaccaguccguauacuacgauuggcuugcugccccuaauccaguggagaaacaccguaagucaaugcccuaucaguuggacgaacugcucaacuuucggaucccuuacuaugucggcccacuggugacagcaaaagagcaaaaggcggcucaagggggaguuuucgccuggauggugcgaaaagaucccgacgguaauaucacuccguacaacuuugaugaaaaggucgacagagaggcaagcgccaauaccuucauucagaggaugaagacaacugacaccuaucuuaucggcgaggaugugcugccuaaacagaguuugcucuaccagcgcuaugaaguacugaacgaguuaaauaacguucgggugaauaacgaaaagcugucuauugagcagaaacagcaggucauaagagagcuauuugaaaggcauaauuccgugacaaucaagcaauucgcugagaaccuccgcgcccacggggacuacgcacacauucccgaaauccgaggacuggcugaugagaaacgguuucuuagcucguugucuaccuaccgucagcugaagucccuccugccagacgccaucgaugacccugcgaaacaggccgauauugaaaauauaaucgcuuggucaacugucuucgaggacgcagccauuuucaagacgaaguuaaaagagaucaacuggcuggauagucaaacaauuaccaaacuuagcaacaucagauauaggggcuggggucaguuuucccauaaauucuugaaugggcucacucugggcaacggacacaccauaauccaggaacuauuucugucuaauaacaaucucaugcagauucugacagacgagacccuucaaaagaaaaugacugaauugaacgcugauaagcugaaggccgcaaauaucaacgacgcgauugaugacgccuacacaagccccucaaauaaaaaggcuuuacgccaggugcuccggguuaucgaggacauaaaaagagccgcagauggccaggacccaaguuggcuguauguggaaacggcugaugggggagguacccccggcaagaggacucgagcccgccagcaucaacuucaggagauuuacgcaaacgccgcucacgagcugaucgacuccgcgguaagaggggaauuggaggauaaaauugccgacaaggcagauuucaaugaccggcucguccuguauuuuaugcagggaggcagggauaucuacacagguaccccucuaaacauagaccagcugagcucuuaugauaucgaccauauucucccacaaucacugaucaaggacaauagucuugauaaccguguguugguucacgcuauuaucaaucgcgaaaagaacgccacauucgccagcacuauauacgcucagaagaugaacgcaaccuggcggcaguggcacgaggccgggcugauuuccggcagaaaauuaaggaaucuccaaaugcgaccggaccagaucgauaaguacgcgucuggauuuguggcucggcagcuggucgaaacgcgccagaucauuaaacuuaccgagcaaaucguggccgcacaguaucccgagacaaagauuauagccguaaaggcuggccugucgcaucagcuaagagaggaacucgaauuuccuaaaaacagggacgugaaucacuaccaucacgcauuugaugccuuccuggcggcucggaucgggacuuauuugcugaagcgauuuccaaacuuacaggccuucuuuaccuacggaaaauucaagaaagcagacguuaagaaacucagagguuucaauuuuauucgcgauaucacacacgccgaggacaagauugucgugaaggauacuggcgaggugaucugggacaaaaagagggaugucgacgaacuggaucguauauauaacuucaaacggaugcuuaucacccaugagguucacuuugaaaaggcugaccuguucaaacaaacgguguacggggccaaggacagcaaggaggcaggaggcaaaaagcaguugauuuccaaaaagaaagguuaucccguggauaucuacgggggcuacacacaggaaaccggaucauaucucaguguagucagacugacuaagaaggcuauguacgccgugguuaaagugucuacaagggacgcggccaagcuagcagucgcuaaaagcauuuccgagcagaaggagaaugaaacccugaacgauaucauagacgagaaacuuucaaagauuagcaagaauggcaaaaucacucaugaacucuuugaggugguucugccucgcguggggcaaaagaccuuguucaaaaacucuaaguauaaucuguuuuuaguaaacuccgauacauacaugcacaauuaucaggaacucuggaugccacgagaguaccagaaaauguggaaggacaucagucugagcaaguauggagaugcccagacggaggaccaacuugaucagauuuucggcuuuauagucucucaggugaacuccuacuucaaucuguacgacaucaaccaauuucggaaaaaguugaacgaugcugcagacaaauucgccacccuccccaugcgggauacugacgacaugcaggguaagauugccacaaucgggcagcugcuaauuggacugcaggcuaaugcggcaaggucagaucuucgcaaccucgacaucaaaaccccgcugggcuuguuacaaauaccuaaugguaucagucuggauagcgacacaucgguggucuaucaguccccaacuggccuccuggaacgugagguucaucuuucugaucuguga

SEQ ID NO: 3235 - RNA, 4170 nt, Artificial Sequence
  Cas9 variant
auggccagagacuacagcgugggccuggauaucgggaccuccucugucggaugggcugcaauugacaacaaguaucaccucauaagggccaaaucaaagaaucuuaucgguguucggcuguucgauagugcggugacagcugagaaacgccgaggcuaccguacuacgagaaggcgguugagccgcagacauuggagguuacggcugcuaaacgacauuuuugccgggccccucaccgauuucggagacgaaaauuuucuggcacgccuuaaguauuccuggguacacccucaggaucaaucuaaccaggcccauuucgcugcaggccuguuguuugacucgaaagagcaggauaaggacuucuaccgaaaguauccaacaaucuaccaccucagacuggcccugaugaaugaugaccagaaacaugaucucagggaaguguauuuagcuauucaccaccuggucaaguaccggggucauuuucuuaucgagggggacgugaaagccgacucagcguucgauguucacacuuuugcagacgccauacaacguuacgcugaaagcaacaauagugaugagaacuugcugggaaagaucgacgagaaaaagcuauccgccgcacucaccgauaagcauggcucuaaaagccagcgcgcugaaacagccgagaccgcguucgacauucuggaucuucaguccaagaaacagauccaagccauucugaagucaguggucggcaaucaggcaaacuugauggcuaucuuugggcucgacaguagcgccauaucuaaagaugaacagaagaauuauaaauucuccuuugacgaugcugacauugacgagaagaucgccgauucagaggcacuguuaagcgacacugaguucgaguuccugugcgaucucaaggccgcuuuugacggacuuacacugaaaauguugcuaggugaugacaagaccgugagugcggcaaugguaagaagguucaacgaacaccagaaagauugggaguacauuaagucucacauccggaaugccaaaaacgcuggcaaugggcuguaugaaaaguccaagaaauuugacggaaucaacgccgcauaccucgcccugcaaagcgauaacgaggacgaucgaaagaaagcuaagaaaauuuuccaggacgagauaucgucugccgauaucccggacgacguuaaggcagauuuucuuaagaaaauugacgaugaccaguuccugcccauccaacgcacgaagaauaacggcacuauaccucaucaguugcacagaaaugaacucgagcagauuaucgaaaaacaggguaucuauuacccauuucugaaggauaccuaucaagagaacucccaugaauuaaauaaaauuacagcgcugaucaacuucagggugcccuacuacgucgggccucuaguggaggaggaacagaagauugcugacgauggaaagaauauaccagaccccacuaaccacuggauggugcggaaaucaaaugauaccaucacaccuuggaaccucagucaggucguugaccuggauaagagcggccgcagauuuauugagaggcuuaccggcacggacacuuauuugaucggggaaccaacacugccgaaaaauucccuccuguaccagaaguucgaugugcuucaagagcugaacaauauccguguaucuggacggcgauuggacauuagagccaaacaggacgcauuugaacaucucuucaaggugcagaaaaccgucagcgccacuaaccugaaggauuuucuugugcaggcugguuauauaucagaggacacacaaaucgagggccuggccgauguuaaugggaagaacuucaacaaugcacuaaccacguacaacuaucucgugaguguccugggaagggaguucguggagaaucccuccaacgaagaacuuuuggaggaaauuaccgagcugcagacaguauuugaagacaaaaagguucuccgccggcagcuggaucaguuagacggccugagcgaucacaauagagagaaacuuucuaggaagcacuacacugguugggggcgcaucaguaaaaaguugcucaccacaaagauugugcaaaacgcugacaaaaucgauaaucagacuuucgacgucccucgaaugaaccagucaauaaucgauacccuguauaauacaaagaugaaccuaauggaaauuaucaauaacgccgaggacgacuuuggcgugcgggcguggauugauaaacaaaauaccacugacggagaugagcaggacgucuacagccugaucgaugaacucgccggcccaaaggagauaaaacgugggauugugcaguccuucagaauccuggacgauauuacgaaggcuguuggauacgcacccaagaggguguaucuugaauuugcccgcaaaacacaggagucucauuugaccaacucgcggaagaaucaacugagcacuuuacucaaaaacgcuggucuguccgaacuuguaacccaggucucacaguacgacgccgcagcgcugcagaacgauagauuguaucucuacuuccugcaacagggcaaggacauguauaguggggagaaacuaaaucuggauaaccucucuaauuacgacaucgaucacauaaucccucaggccuauacaaaggacaacagccuggacaauagggugcuuguuuccaacauuaccaaucgacgcaagucagauagcucuaacuacuugccagcucugaucgacaaaaugcggcccuuuugguccguguuaaguaagcagggacuccugagcaaacauaaguucgccaaucuuacuagaacaagggauuuugacgauauggagaaagaacguuucauugcacgcucucuggucgagacgcggcaaaucauaaagaacguggcuucccuaauugacucacacuuuggcggugaaaccaaagccguagcaaucagaaguagccucacugccgauaugaggcgauacguggacaucccgaagaaucgggauauuaacgacuaucaccaugcuuucgaugcgcuguuguuuucgacaguugggcaguacaccgaaaauuccggccugaugaagaaaggacaguuaucugacagcgccggcaaccaauauaaucgcuacaucaaggaauggauucacgcagcuagacucaacgcccagucacagagggucaacccuuucggguucguggugggaaguaugcggaaugccgcucccgguaaacugaacccagagacaggcgagauaacuccugaagagaaugcagauugguccaucgccgaccuugacuaucugcauaaggucaugaacuuucgaaaaauuaccguuacgagacgcuugaaggaucagaaggggcaacucuacgacgaaucuagguaucccagcgugcugcacgaugcgaaauccaaggcuucaaucaauuucgacaaacauaagccaguggaucuauacggaggcuuuagcagugccaaacccgcauacgccgcucugauuaaguucaagaacaaauuucgucuuguaaauguccuccggcaguggaccuauucugacaagaacuccgaggauuacauccuggagcagauaagagguaaauauccuaaggcagaaaugguguugagccacaucccauacgggcagcugguuaaaaaggacggcgccuuagugacaauuucgucagcgacugagcuccacaauuucgaacaacuguggcuuccgcuggcugauuauaaguugaucaacacccuccugaaaacaaaggaggacaaucuagucgauauucugcauaacaggcuugaccuccccgaaaugacuaucgagucugccuuuuacaaagcauucgacaguauacuguccuuugccuucaaucgcuaugcuuugcaccagaacgccuuagugaagcugcaggcacaucgagaugacuuuaaugcucucaacuacgaggauaaacagcaaacccuggaaagaauuuuagacgcccugcacgcgagcccugccucuagcgauuugaagaagaucaaucuauccucaggauucggccggcuguucaguccaagccauuuuacgcucgcagacacagaugaguucaucuuucagucuguuaccgggcuguucuccacucagaaaacaguggcucagcuuuaccaagaaaccaaguga

SEQ ID NO: 3236 - RNA, 4170 nt, Artificial Sequence
  Cas9 variant
augaagaacuacaauaucagccuggugcccuccccuucuggcgucggguaugccguuaccgacgauaaccucaauauuauaaaaccagugcaccauguaucaggaaucgguaguagacuuuucaacgagggcagcuccaagcaggacaggcgcaauucucggucggcucgacguucaagacacaggcaacaggggcggauuaaagcacugaacagcaucaugaaggaugaaauuaucaaaguggacccgacauuuuucgaucgcuuguaccagagugaguuaucaccccuggacaagaauaagaaauauagaaacauaaucuuugauaagccuucugucgaaagcuacuauuacaaaaaguucccaacuauuuaucaucuagagaaauaccucaucaauacggacggaaaggccgauauuaggcugaucuacugggcgcuucacucccuguugacccaucggggccacuuuuauaacacaacucccgugucacaguucaagccuggugcucucaauauaaaagacaaguuuauugaacugaaccaacugaaucagguuaaaaccuucgaguuuaguguggccaacacaccagagaucgaacacauucucaaggaucgcuacaucagcaaacagaauaagaucaaccaguuagcagagcugcuuuucgaacaagagcccgagaaagacauucagaaggccaacaccaaggucgcuaaaacuauagcaaaggccaucuuggggaauaaauuucagcuggaugaaauuaucggacuagacgugaacaagucugagaaaaaggaauggucccuccagcugucagaccuuaaucuggauagcaagauagacgaguugagugauucucucacagaccaacagcugcgaauuuuagaaauccugcaggagauguaugcugccaccacgcuccuugauauccugcaaggcuccgacagcuugcuagaugcgaaaauuaagucguacaacgaguauaaacagaauagacuccuguucuuugaccugcuuaagacucugccugauaaaaaggcacauuugcucaggcagggcuacacccuguauuuaaacaaucaccaucgggaccuggccucugcucguaaggaucuagggaucguagccgcaacaaacuucuccaaaacugaccucuacgcucugauuaagaaaacccuuaaggacgaaccagagacaccggaauccaaaaagguuuugggacugauagauaagggugaguuccucaauaaacagcgcaccgaccugaacacguacauccccuaucaacuuaaugcccugauuuugaacaagauccucaaaaaucagggcaagcacuacccuuuucugaucaaagaaaacccagcggagcccgauagaaaggaggccccuuaugaaauuagucaguuaaugcaguucacuauaccauacuauugcgggccccuggcaacaccggaggaacaaaagaaucuaccugagagcuccagguuuggauggcucgugcggaaggaagagggccgaaucacccccuggaacuucuacaacaagauuaaugucaucgagacugcuaacgccuuuauuaaacgcucuaucgguaaggacacauaucugcuuagcgaaccaguguugccugauaauucacugcucuaccagaaauacaaggugcugaacgaguuaaguuccauaagccuggucgacgcuaauaccaaaaaggaaaagaaacuuacggccaagaucaaacaguugcucuauaaggagggguucaaaaagcacguuaccgugucuaagacaauggcacugaaaauucuaaacgauaauaacguacccacuucagacauccugggacucaguaccggcaagaaauuugauaauagccuguccacauacaacucuuggaagaaagccuucccagagcagauugacaauccccauuauagacaagaucuugaauacaugaucgaguggucgacuguguuuaccgacaggaagauauuggucgaaaagcugaaagagauugaaugguuacggccugagcagaucaaguucgugcucgagcaccgccugacaggcugggggaaacuuagcaagagacuguugguugaacucaaagauaacaagggaaaauccaauauugacaaccuguuuaauaccaagaagaacuucaugcagaucgugucacagcaagucuauaacacucagauagaggcuaucgcgcuaaaaacgacaaagaaucagagucuggacaacauucucgaagcagccuacaccucuccagcuaauaggaaagccauccgucaaacuaugaaggugguaaacgagauuguuacccuggcagguaaaggcacacauccggauaagaucuuucuuaccuuccagcggagcaaggaacaggaggggaaauugacuacagaccgagccuccucacuguuaaagauauauagaggaauuaaagauccccucuguacgaaggagcugguggacgaacuuagcaaaaaugucagggcuaaccugaucaagaccaaggaguaccuauacuaucagcaacucggccgcgaugcccugacuggugaaaucauugacaaaacagauuugcggaauuacgcagugcugcacaucauuccuagaucugucgugguugacgauuccauaaacaauuuagugcucaccaagguaaagaacgcgaaggagaguaucgucgugcaguaugggagcaaaaauauuucugacaucuccaugucaguuaaggauuucuggaacaggcugcagaaacuuggccuguuuaguaaaggaaaguugcgcaaucucacaacugaccugaccgaacuaaaccaguacgagaaacaaggcuucauugcucgacagcugguggagacgaaucagaucgucaaacuucucgccaccauacugcaggggcaauuuccacauacaaaaaucauugaagugcggcaggagcagaucgcaaacauucguuaucaauuggauaucuacagacugagggacuuaaacguauauuaccgcggaauggacgccuaccucgcugccgugguugguacuuaucuguacaccgucuaucccaaggcacggagauucuuuguguacggcaaguaucuuaaacaggauaagaauaacagggaagaggggcaguucaaaacaagcggacacucguuuaauuuccuguggaaguuguuuuacggcggugaggacgaaauauaugugcaggggacuaacaauauugcuuucaacaaaaaggaucuccugcagaaaaucaaggaggucaauaacuacaaguuucaaaauguuucccuagccaccggcacgcgacgcucugaccuguucaaacagacaaucuacccucggcaggaaagagaugugaagaaaagcaggacccuuauuacuaagaaaaacggacucuuuacagacauauauggcggguacaccggaaaugugaacucauauuucguacugguccaaacuaaguacaagaaagauccagacaaguucaauuuguauggugugcccaaccguuacguugcgauguuagagcagaguaaauccaagggcaauuaugaaaccaaacugaaggaggugauggagccgaucauuaagaacucuaauaaacgcaugaucggguacaagauucucaaagaucggauccuguacaaccagauaaucgaagacaacggauauaaguuuuucauuacaagcucccaguacagacacaauuuuaggcaaaugauccuuucagaucagagcaaaaagauucugauggacuaugucuucgacccuaacuuuuaccgacauaagaaaacggaggaugugaauaacgacaaggaugccaaauugaucaagguuuaugacgaaauacuauaccagauugaucacuaucugcagaucuucaccaucggccaucacauugacaaacucaagaaagcucggccacuguuugagaagugcacucuugcagaaaaggcccaaguguuaaaugauauccugauaauugcugguaguaaccagacagagcucgccuugaaaccccugaagaccacaaaacucacuuucucuaagcagaauuguccucugaccaaagacgcaaucuuuuacuaccaaucccccacggggaugauuacacgcaaggagagcaucaaggauauacuuaaacagaacauuuga

SEQ ID NO: 3237 - RNA, 4173 nt, Artificial Sequence
  Cas9 variant
augagcagaaagaacaucguggaggacuacgccauuucccuggauauaggcaaugcuucugucggguggguugcauucacccccaacuauaggcucgugcgggccaaaggacacgaacuuaucggugcgcgccuguuugagccugcuucaacagccgaagaacgacguauggcaagaacuacgaggcggcgcuacaguagaaggcgguggcgcuugcgaauguuagacagcauguucgaucaggcccuguccgaaguagacccaucuuuucuaaugagaaggaaguauucgugggugcauccggaggauaaaaauaacgaggcucacugguucggcgggguccucuuugacucaaaugaacaagauaagcgguucuacgagaaauaucccaccauuuaccaucugcguaagagccuuauggaagacgaugagcgccacgacaucagagagguguaucuggcaauucaucacaugaugaaguacaggggaaacuuuuugacagaaggcgagcucgccccuaguuccguuuucgauguggaagacuuucugaaacugcucacugagaucuuacaguacgcugaugaaggugagaccgacgaggaccuggaacuucaggccgaugcgaauggguugacagaggcacugugcaccacuaagggaucucggagcauacgagccaaaaacgcuaucuccauucuaaaggaaggcgccgcacucucaaaacgccaggaggcuaucauuagugccgucuucgcgggccuggaagggaauaaacuugaccugacaaagguguuuccaaacaaagaguauacccccgaggauaagaaaacguuggcccucuacuucaauaaggcagacuaugaugaaaagagaguagcuaucggagacagcggucuguuagaggauaacgaaugugacuuucuggauugcauaaggcggcaauacucugccauugcucucaagcagcuucugggcgacuucacuuccaucucagagagcaugugugcccgcuaugaacagcaccagagaaauugggauuugauuaaaagguacugccgugaggagaguaacgcagaaaauaucaacaagaacuauggggcccuaguuggaugggagaucgugggcggucaacggcgaucuauuagaggggcuaaggacuacgaaaauaaaaggaaggcggcaaacaaauucuuugaggagcugauaaagggauccgcccucccugaccaggaaaaagagcgccugcuucaugauaucgaaaaugacgagcuguucccaguccagcgggauagcggcaacggcgugauucccuaccaguugcaccucaaugaacugaagaagaucauacaaaaacaggggagauauuacccuuuucugcuggagaccuauauuaaggacggaaaagaggugaacaagcuagaaggucuccuggcuuucagggucccauacuauguuggcccgcuugugucgcgcgaugacaugcagucuuccgauaaucgagagaaccauuggaugauccggcguaaaaaggggguaaucacacccuggaauuuugacgaaaugguggauaaggacaaaucaggacacgaguucauuaagaguuuggucggcacugauagcuaccugcucggugaaaccacacugccuaaaaacucccuucuguaucaagaguuugagguguugaaugaacucaacaauguuagacugucuaucaggaccgggaaccacugggccgacaagcgccgggugagauuaggccauaaugagaaaaagcugcuacucgaggagcuguucgcaaagcaggccacggucacuaaaaaggcugccgaaaaccuuuugaggcgaacauacggaaacaccuacgagauuagcggccuggcagaugagaaaaaguuugugucaagucucuccagcuaugggaaaaugugucgcacucugaaggcgucuuacguaaauucacacaaagacguuguggaaaagauaaucgaguuacagacagucuucgaagacaagaaaacccugaagcaucagcuucaauugcucggagagcuggcugagacgaacugcgaacuacugaguaauacccacuauacagguuggggcaaacucagccggaagcugcuuacuuccaaaguggucguguguaagauugggaacgauuuugccccagcaaagcauucuaucaucgagauuaugagagaaaccgacaggaauuucauggagauaaucacagauaaagacuugggaguuggcgaauggauuaaccagcagaaugugggugccgaggaugggaacucguaccaggacaucauugaugaccugcguguaagccccaaggucaaacgcggcaucaaucaagcuauacgggugaucgaugacauuuccaaggccguuggaaaagagccuucaagaaucuuuuuagaacucgcaggcgaugugcagcagagugcuaggacugucucucgaaagagccggcugcaggggcuuuauaaguccgccggacugcaaaaagaguuccgcgacuuggcggaaucacucaacgagugcagcgauaaugaccugagagacgauaggcuauuccuguacuauacccagcucgguaaggacauguacacaggcgaaccacugaaccuugaucgguugucuuccgacuacgauauugaccacaucauaccccaggccgugacccagaaugauagucuggacaaccgaguauuaguggcuagaguugcaaaugcccgcaaaacugauagcuuucaauaucucccggagauugcuaacaggaugcguaacuucuggcaggagcugcuugacgccgggcugaucucucgggucaaguuugauagacuaaauaggcagaacgacuucuccucacacgaaaaagagcgcuuugugcaacgaagucucguggaaacgagacagauuaugaagaaugucgcaacaaucaugcggaagagguacggaaacagcgcggccguuauaggcuuaaauucggaguugaccaaagaaaugcgccaguaucuggguuucucccauaagaaccgugacaucaaugauuaccaccaugcucaggacgccuuaugucucgggauugcaggccaauuugcugugaacagaggauucuuugccaauggcauggugucugauggggcaguaaacagcuauaaucuguaccuucaggacuaucugcggggauacagggagaaaaugucagccggcgagcgccgaagaaacaaggcuuucgguuuuaucgucgggaguaugaacucccaggauucugacaaacggauuaauccuaagacuggagaaaucgcgugggaugacgaggauaaaguguacuugaggaagguuaugaauuaucgcaagaugcucauaacccagaaagugggcgacagcuucggugcccuguacaacgaaacaagauauggcaccuccgcaaaggagggggucaacggaauccccuuugauaaacacaagcaagacacugcucuauacggcggguucucaagcgccaaaacaguguauguugugcugaucgaggccaagaagaaaacgaggcuuguaaauaucaccaugcaggaauacgcugagcucggagaucacccaagugacgacgcacugcgggccgucuuggcgaagaaaaagccugaauauggcaaagcucguauucuguuacgccauauucccccaaugcagcucauucgauacgguggggcccuggugacugugaagucugcaacagagcuuaacaaugcccagcaacugugguugcccuacaaggaauauugccucuucgaugacgucauauccagcgcuaucgauguugacgaggcaagacugugucagaugcuagaugugauucuggacgccauccagaaauacuauccuaagcaaagguuugaugagaccggacuuucggcguuccacaacgcuuuuaaugaaguaucagccgaggacaaaaagcggauugugggcgaaauggucgguaugcuccaugcagaugccaaaaacgcuaaucugaaggccuugggcaugucugggcgcuggggaagaaugaguaaccaguccggcuacacauucgcagacagcgaugaguuuaucuuccagucuccaagcggguuauuugaaaagaggauauccgugggagagcugaaaaagcggcgagcuagauga

SEQ ID NO: 3238 - RNA, 4173 nt, Artificial Sequence
  Cas9 variant
augaaggaggugaaagacuacaucauuggccuggauauagggaccaacagcugcggauaugucguuacagacaagcagaauaacauccucaaacuuaaggguaaaacugccauuggcgcuagacuguucaaggaaggggaggcagccgcggauaggcgggcuuuucgcacgacccgacguagauuggccaggcggcgcuggagauuaggacugcuagaagagaucuucgacgaagagauggcaaagguggauuccucuuucuucaggcggcucaaagagucagacuacagucccaaggauagccgcaaacaauuuaauuccauuguauucgaaucuucggaggccgacaaggauuuuuaugacaaauacccuacaaucuaucaccuucgaaacgcucuuaugcaugaugaccagaagcacgaucugagagaaauauucuuggcagugcaucacaucgucaaguacaggggcaauuuucuccgggaggacucagugaaagccuucaaggcugccaaauuuacucugcagggugaggacgggauuggaccaguugauaagcugaacgaccucuuaaaagaaaucuauauugaggcggcaccggaacuggccaccgauaaucuuagcaagaucgaggaaauaauuaaagacaagaaguuguacaaacaggauaagcugaaacaaguggcuacacuacucaccaaggaggccgacacuaaagauaaggcaaagcugaacaaagacgucgcuaaacagguggccaaugcguucaugggcuacaugaucauuuuugauacaaucuucaaccuuagugacguagauuccaaagacuauaagguuaaauucucugacgccaauaucgaugagaagcuggacaccuugacgagccuccugacugauaagcagaccgaauuuguguuagagcugcagaacauuuacaauacaauaguccucaacgaaaucgugcccgacggcaaaucccuuucagagaguauggugaagaaauaugaugaccauaaggaagaucugaaauuguucaaggcauaccuaaauagccugacugacgucaagaaaguuaaggagcucaaagcugccuaugugcuguacguaaacaaccguaaggcuaaucuucuggccgcaaagaaguugcucgggaaaaaggccgauaacaugaauaacuuugagauuuucucuaaguuuguggcugacaaucuggaugacuccgaauuagcgaacaaaauccgcgcaagacuggaucuaggagaguuccucccuaagcaaaggaccaaucagaacggugucauaccauaucagcugcaccagguggaacuuacacaaauuuuggagaaacagggcaaguacuaccccuuucugaucgccccuaauccaguugaaucacaccggaacaaugcucccuaucgaaucagcgagcucgugaguuuccgcgucccuuacuauguggggccacugauugacccgaacaaugccgagucugaacaggacaaagcaaacuccagcuuugccuggaugguaagacaaaagcagggacagaucacccccuggaauuucgaggaaaugguugauacgacugagucggcuaacaaguuuauuaaaaggaugacaaccaaggacacuuaccuucugggcgaggauguguugccugccucuucccucauauaucagaaauucgucauccugaacgaauuaaauaacauuaaggugaaugguaucaaacugacaucagaggaaaagcaucaaaucuuugacgagcuauucaagguccagaaaagugugagccucaagaaccugguuaauuuccuuaccgcacacggguguguggcgccaaacguaacgggauuguccgauggcaccaaauuuaauucuagcuacucaacauauauugacuaccggaagauauucggcgcugaaaucgauaacaaagacaagcaggccgauuuugagaagaugauugaguggaguacugucuucgaagaccgcaaaaucuuuaagagaaaacuggaggaaauuaccuggcucacacccgaucagaucaagcaaguguccagcaaaagguacucuggguggggacgucugucaaagaaauuacugacucagauaaccgacgagaaugguguuaacauccuucagcgguuguggaaugaaagugagaaccucaugcagauucugagcgauccugugaucaaggagaagauugucgcagccaauuccucuuucacaaaagcuaccgacauggaagacauccuagccgaggcauauacuucgccacaaaacaagaaagcuauacgacaggugaugagaguaguggaugacauuaucgccgcggcccauggcaagaaacccagccagauugcuaucgaauuugcaagggaggaucaggacaauccgcaaaugacgaagucccgcaaggcccagcuggaucagauauacgcuaaaaucucagacgaauuucucgauaacgccguuaagaacgagcugaaaaauaugaaggacaacaaaccucuugcaaaggauaaggucuuuuuguauuucaaacaaauggggcgggacgcguacacaggagagaagcugaguuuagauaaucuccaggacuaugacauugaucacaucuacccccagucuuuuauuaaagacgauagcuucgacaacagagugcuggugcagagggccgucaauaacggcaaguccgauaauguuccagugcuucuguuugguaacaaacaagcugccgacuuggggaugaccauccgccagauguggaagaaguggcucgaacugggccuaauaucaaaacgaaaguucaauaaccugauuacugauccugagaaaaucagcucuuauauggcauccggauucgugaaucggcagcucguagaaaccagucaggucaucaagcugguggcuaacauucuucaagccaaauugcccgacacagagaucauugagguuaaggcaagcuacaauucuauacugcguaaggaauuuaacuuauacaaauccagagaggugaaugauuaucaccaugccaucgacgcuuaccucaccacuauugucggcaacuaucuguaccagguguauccaaagcugaggcccuacuucguuuaugggcaguuuaaaaaguucggaaaagcggaaucaaaggaggaugacccugugaaaaagaucaagcaguuuaacuucauuuaccaacugcuaugggguaaagaugacgccaucugcauaagucacacagaccagcagguauuuagccgcucggauaucauuaauaagcucacgaccgcauacaacuucaaauauaugaaugucucccaagaaguguacacuaacucuaauaacguguuuaagcagacagucuucccaaucauugagcgggacaccgcuaaaagcagaucacugaucccgaagaaguuggauaggcccacagacauauauggcggguacaguaauaacaaugaugccuaucuggccuuaguuaaaguggacaagaaaaagggauccgaguaccgaguagugggcauuccuaugcgcgcugcagccaugcucaaagcgucuaagaacuaugaugaagaccugcggaaggucaucgagccaauggugaugcuugauaaaaaugguaaggcuaaaagagggaucgaaggcuuuaggguucuggugggaaagaugcccuucaaacaggccgucuuggacggcgauaagaaguucaugcucacugggaccaacgacaugccuaaucugaaacagcuagugcugagccaacagaacaugaaguacauucuugauuacauagacgacaucgauugucguaaacauaaguuuggaaauaaaacgcaggacgguaacaagugccuccuggagguuuucgaugaaauuauccagauuguggacaaacacuuugaguuguucgauaaucgcuccuuucgggagaagcugagaaacucaagggucaacuucaucaauuuagcacucagcaagaaagccgaagcucugcuugcaauacugaacggcuugcaugccaauaguaugcgaaccacaaucaaggagcucaaaauuucugaccuggggcggauccaauccagcguaauuucgccagaagcgcagcuaaucuaucagucacccacuggacuguuugagcgcagagugaagguuaaagaucuuuga

SEQ ID NO: 3239 - RNA, 4176 nt, Artificial Sequence
  Cas9 variant
auggagaacaagcaguacuauaucggccuggacguggggaccaauagcgucggaugggccguuacagauacuuccuacaaccuccuuagagcuaaagguaaggacauguggggcgcaaggcuguucgaaaaagccaauacggcggcugagcggcgcaccaagcgaacaucucguagaaggucagaacgggagaaagcccgcaaggcaauguugaaggaauuauuugccgaugagauuaacagaguggaccccaguuucuuuauaaggcuggaggaaagcaaauucuuucuagaugaccgguccgagaauaaccgccaacgauauacucucuucaaugaugcuaccuuuacagacaaggauuacuaugaaaaauacaagaccaucuuccaccugagaucugcacuuauuaacucggacgagaaauuugauguaaggcugguguucuuggccauccucaaucuguuuucacaucgggggcacuuccugaacgcuagccucaagggagacggcgauauucaggguauggacgucuuuuauaaugacuuaguggagaguugcgaauacuucgagaucgaacugccucguauaacuaacaucgauaauuucgagaagauucuuucccagaaagggaagucucgcacaaaaaucuuggaggaacugagcgaggaacuauccauuucaaagaaagacaagaguaaauacaaccucaucaagcugauaagcggacuugaggccucuguuguggaacuguauaauauugaggauauccaggacgaaaacaagaaaauuaagaucggcuuuagagaguccgauuacgaggaaucgagcuugaaagucaaggagaucauuggcgacgaauauuucgaucucguggagagggcgaaaaguguacaugacauggggcuguuaucuaacauaaucggaaauuccaaguaccugugugaagcacggguugaggccuaugagaaccaccauaaggaucuccuuaaaauuaaggaacuguugaaaaaguacgacaaaaaggcuuauaaugauauguuucgaaagaugaccgacaaaaacuacagcgccuacguggguucggucaauucuaacaucgcaaaggagcgcagauccguggacaaaaggaagauagaagaucuauauaaauacauugaggacacggcucugaagaauaucccagaugacaacaaggauaaaaucgagauucucgaaaagaucaaacugggcgaguuccuuaagaaacaacugacugccucaaauggggugauuccgaaccaguugcagagucgggaacuccgcgcgauacugaagaaagccgagaauuauuuacccuuucugaaggaaaagggagagaaaaaccuaaccgucagcgagaugaucauucagcuuuucgaauuucaaaucccuuacuauguuggcccacuggacaagaaucccaaaaaggauaacaaagcaaauuccugggcuaagaucaagcagggugggaggauucuuccuuggaacuucgaggacaaaguggauguaaagggaucuagaaaagaauuuauagagaagauggugcguaaaugcacauacaucagcgacgaacacacuuugccaaagcagucacugcucuaugagaaguucaugguccugaacgagauuaauaacaucaaaauugauggcgaaaagaucaguguggaggccaaacagaagauauacaaugaccuuuuuguuaaaggcaagaaggugucccaaaaagauaucaagaaagaacugauuagcuugaacaucauggacaaggacucuguccucucagggaccgauacaguguguaaugcuuaccugaguagcauuggaaaauucaccgguguauuuaaggaggaaaucaacaaacaguccauaguugacaugauugaggauaucauuuucuuaaagacgguguauggcgacgagaagcgguucgucaaagaagagaucguggaaaaguacggggaugagauagacaaagauaagaucaaacgaauccugggauuuaaguucucuaauuggggcaaccuaucaaagagcuuucucgagcuggaaggugccgacgucgggacuggcgaggugagauccauuauucagucacuuugggaaacaaauuucaacuugauggagcugcucaguucuagguuuaccuauauggaugaacuggagaaacgcguuaagaaauuagagaagccccugagcgaauggacuaucgaggaccuugaugacauguacuuguccucaccugugaaacggaugauauggcaaagcaugaagauuguagaugaaauccagacagucaucggauaugcaccaaagagaauuuucguggagaugaccaggucugaaggcgagaaaguucgcacgaagucccgaaaagaccggcucaaggagcuguacaaugggaucaaagaagacaguaagcagugggugaaggagcuagauagcaaagacgaaucuuauuuucguuccaagaaaauguaccuguacuaucuccagaagggaagaugcauguacucaggugaggucauugaacuggauaaacuuauggacgauaacuuguaugacauagaucacaucuacccgaggaguuucgugaaggacgauagccuggacaauuuaguacucgugaagaaagagauuaacaaucgcaagcaaaacgaucccaucaccccucagauucaggccucgugucagggcuuuuggaaaauccugcaugaccaaggguucauguccaacgagaaguauucucggcuuacaagaaaaacucaggaauuuagcgacgaggaaaagcugucauucauaaauaggcagaucguugagaccggacaggcuacaaaaugcauggcgcaaauuuugcagaagaguaugggcgaggaugucgacgugguguuuuccaaggcacgacucgucucugaguuccgccacaaauucgaacuguuuaagagccggcuaaucaacgauuuccaucacgccaaugacgcuuaccugaacauuguuguggguaauuccuauuuugugaaauucacuagaaacccagccaauuuuaucaaggaugcaaggaaaaaccccgacaauccuguauacaaguaccacauggaucguuucuuugaacgcgacgucaagucaaaaagcgagguggccuggauagggcagagugaaggcaacucuggaaccauuguuaucgugaagaaaacaauggcuaaaaauuccccacucaucaccaagaaggucgaggagggccaugggagcauuacuaaggaaacgauagugggaguuaaagagaucaaguucggucggaacaaaguggaaaaggccgauaaaacacccaagaagccgaaucugcaggcauauagaccuauuaaaaccucggacgagaggcuuuguaacaucuugcgauacggcgggcggacuucaauuucuaucaguggauauugccugguagaauacgucaagaaacgcaagaccauaagauccuuagaggcgauccccguguaucucggcaggaaagauagccugucugaggaaaagcuccugaauuacuuucgguauaaccuaaacgacggugggaaagauagcguguccgacauucgacucugucugccauucaucucaacaaauaguuuggucaagauugacggcuaccuguacuauuuaggaggcaagaacgaugacagaauccaacucuacaaugcuuaucagcugaaaaugaagaaagaggaaguugaguacauacgcaagauugaaaaagccgugagcaugucuaaguuugaugagaucgacagggagaagaacccuguacuuaccgaagagaaaaauaucgaacuguauaacaagauucaggauaaauucgagaauacuguguucuccaagcguaugucauuggucaaauacaacaagaaggaccucaguuuuggggauuuccugaaaaauaagaaaagcaaguuugaggaaaucgaccuagagaaacaaugcaaggugcuguauaacauaauuuucaaucuuuccaaccucaaggaaguugaucugucugacaucggaggcucgaaaagcacagguaagugucggugcaaaaagaauauuacgaacuacaaagaguuuaaguugauccagcagucaauaaccgggcuguacuccugcgaaaaagauuuaaugacuauuuga

SEQ ID NO: 3240 - RNA, 4176 nt, Artificial Sequence
  Cas9 variant
augaaggagaucaaagacuacauuauaggccuggauaucgggaccaacagcugcggauauguggucacagacaagcagaauaacauucucaaacuuaaggguaaaacugccaucggcgcuagacuguucaaggaaggggaggcagccgcggauaggcgggcuuuucgcacgacccgacguagauuggccaggcggcgcuggagauuaucccugcuagaagagauuuucgacgaagagaugaauaagguugaucccagcuuuuucaggcggcucaaagagucagacuacaguccuaaggaucgccgaaaacaauuuaacagcaucguguucgaauccucugaggcagacaaggccuuuuaugaaaaauacccaacaauauaucaccugagaaaugcucuuaugcaugauaaccagaagcacgaccugagggagaucuucuuggcaguacaucacauugugaaguaccggggaaauuuucuccgugaggauucggucaaagccuucaaggcugccaaauuuacucugcagggcgaagacgguaucgggccgguggauaagcugaacgaccucuuaaaagagauuuauaucgaagcggcacccgagcuggccaccgacaaucuuucaaagauagaagauauuaucaaagacaagaaguuguacaaacaggauaagcugaaacaaauugcuaaccuacucccuaaggccguugacagcaaagauaaggcaaagcugaauaaagacaucgcuaaacagguggccaacgcgcuuaugggauacauguuccgccuggauacauuguuuaguuucaccgacgucgaugugaaagacuauaagcucaaauucuccgaugccaauaucgacgagucucuggacgcauuaacuagccugcucacagaugcucagauugaguuuguacuugaacugcaguccauauacaacaccaucguuuugaaugagauugugccagacggcaugucacuaagugaaagcauggucaagaaguaugaugaccauaaaaaggaucugaaacucuacaaggaguauaucgacucucuguccgaucaaaagaaggccaagcagcuugaagcugccuacgcacuguaugugaacuacagaaaagccgacuugcucgcugcgaagaaacuguucgagaagaaaaagauaggcgauaaaaaguuuguggacgucauuucaaacuucgagguuuuugggaaguucgugagcgauaauuuagacgauagugaacuggcaaacaaaaucaaggccaggcuagaccucggagaguuucugcccaaacagcggacgaaucagaacgguguaaucccuuaccaacuucaccagguggaauugacucagauucuggagaagcaaggcaaauauuacccauuccucaucacccccaauccugucgaaucucaccgaaacaaugcuccauaugagauuuccgagcuggugagcuuucgcguuccguacuauguggggccccuuauagacaaccagucgaucaaggauaagcagaauaaaaacaaguucgccuggauggucagacagaaacaaggacagauuacaccuuggaauuuugaagagaugguggacacuaccgaaucugcaaaccaguucaucaagaggaugacacggaaagauaccuaccuguuggccgaggacguacucccaaaguccucacugaucuaucagaaguuuaugauuuuagaugagcugaaucgcauaaaaaucgacggcaagaaacuaacgaguaagcucaaacaugauauuuucgaaaagcuguucaagaaacaaaagagcaucaaccuugacaauuugaaaaacuaccugcucgcugaggguaacauucccgggcugaucgaaggauuauccgauggcauaaauuuuaacaauucuuucagcacuuacaucgacuauagaaacauuuuuggcgaugagaucgacaauccuaacaagcaggccgauuucgagaaaaugauugaauggucaacaguuuuugaggacaggaagaucuucaaacguaagcugaaggaaauaaccuggcuuacuccagagcagauuaaacaggugaguuccaagcgguacagcggguggggacgauugucuaaaaagcuccugacacaaaucaccgacgaaaauggugucaacauucuacagagacuguggaaugagcccgaaacgcucaccgaggugcuggcaaacccggucaucaaaaggaagauaucagaggcgaauagucuuuuugugcagaucaacaagguugaaaauauuuuggaugacgcuuauacaagcccucagaacaaaaaggccauccgccaagugauucggguagucgaugacaucauagcagccgcucacggcaaaaagcccucccagauugccaucgaguucgcaagaucuucgcagaauaaagcuaaggugccagauacuaggaagaaacaacuggacaagaucuacaacaaaauuagcuccgaaaucuuagauucaaguauuaagaacgagcucaaaaaucugaagucuaacaaguaucuuagcaaagacaagcuguuuuuguacuucaaacagauggggcgcgaugccuauaccggagacaagcucucccuggaucagcuacagaauuacgacauagaccauaucuuuccucgaucauucauuaaagaugacagccuggauaaccggguucucacacaaaagcccaucaaugcgaagaaaucugacuacggcauuccagcccuggaauuugguaacaaguaugugcccgaucuugggaucacugucaaagagauguggaaguuguggcaggagaauggccugauauccaaaaguaaguuaaucaaccucuguaccaauccuaaaaagauuggaagcaagcgugcuucuggcuucaucaacagacagcugguggaaacaucccagguaauuaaacuuguggcaaucauacugcaagccgaguucccagacaccgaaauuaucgagguuaaggcucuacagaauacuacgcucagggagucauuucaccuguacaaaaaccgcagugucaaugauuaucaccaugccaucgacgcauacuugacaaccauuguggggaacuaucuguaccagguguauccgaaguuacggcccuacuucgucuacggacaguuuaaaaaguucaaucaagaaaagaacauagauauccucaaaagacugaagaacuuuaauuuccuuaggcagcugauuuuuaacacugacgauaauaucuauauuagcgguaccaaagagaucguuuucaacaagaaagacauaauccacaaguuggaaacagcguacggcuauaaguacaugaauauuucgcgagagugcuaucaggaaaccuccucucucuuuaaccaaacucuguacgcccauaauagcucagugaaaaacagucuaaucccuaagaaaaaggggcugccaacagagauuuauggaggcuacuccgguaauaaagauucuuucuuugugcuuguaaagaucgucaagaaacgcacgaaccucuaccggauaguggggauucccaccagagagcuggcuaaguugaauagcuccaacaauuauaaccaggcccugaauaaaaucguugaaucaaaguuaugucucaaagagacugaaucuuucaagauccugauuaaaaggcuucuguacggcacauugaucguggacaacggacagaaguuccguauaggcaguuuuaaggagaaacacaauguccagcaacucgugcugcagcuaaagucuaugaaauauauuaaguucuacaucgacgggggacagaacuauuuuaccgauguugaacgcaaaaagcuggagaagcaggaccgggauaaaugccuucucuacguguucgacgauauuaugaacguagucaauaagagauuuacacuguucgacauguccaaauaugagaaggauggugacagcuugagggaaaaauuuaacuguuuagauuucaaugacaaggugucgauccugucagaucuccugaaggcauuucaugcuaacucugaccgaaccaguauaacuaaacuuaagauuacgaaucugggccggcaccaagccgggaaaaacggaaucaccuugacaacuaaugcacagaucauuuaccaguccccuaccggccuauucgagcgcagaaucaagauuaaagaucuguga

SEQ ID NO: 3241 - RNA, 4176 nt, Artificial Sequence
  Cas9 variant
augaagaaaauccugggccucgaccuugggaccaacagcauuggaugggcccuggugaaugaggcugaacacgagcaugaacaguccucuauagucaaguuggguguuagagugaaccccuuaucaguagaugagaaaacaaauuucgaaaagggcaggccucugaguaucaacgcagaccggacuagcaaacgcuccgcccgacguaaucuacaaagauuuaagcucaggcggaagaaccugauuaaucuucuguugaaacaccauaucauuucuaacgagacgauccucaccgagguggggaagaauacaacucaccagacccugaaacugcgcucgaaggcgacacaggaaaagauaucacucgaggaauuugcuagaaucuuacugagcauuaacaagaagaggggauacaaaaguucccggaaggagaaaaaugaggaugaaggcuucaccaucgacgguauggccauugcaaaggagcuuuaugauaaccaguugacuccagggcaauacgucuauaauauccugcaggacggaaagaacuacauaccggauuucuaucgcucugaccuacaggccgaauuugaugacguguggcaguuccaaaagaaauuuuacagcuccauucucacagaugaguucuaucugaaacuuaagggccagggcaaagaaaauacccgaaagcuguuuuuggcuauccaucagguuuacacggcagagaacaaagggaagagagacgccgugaaacuccaguacuauaaguggaggucagaggcugucaagaaacaacugaguauugaagagguggccuacguauuaguugaaaucaacaauaacaucaauaagagcucuggauaucugggugcgauuuccgaucggucaaaagcacucuacuucaacaaugagacugugggcgaauaucuuuacgggcagcuggucaagaaccgucacaauagcuugcgcaaccagguguuuuauagacaagacuaccuagacgaguucgagaaaauaugggaaacccaggccaaguuuuacgaugagcugacaaaugaacucaagcaggagaucagggacguggucauuuucuaucagcggaaacugaagagucaaaaacaccuuaucucugauugccuguucgaaaagcaucacaaagcuauacccaaguccagcccuuuguuucaggaguucaagauuuggcagaaccucaauuaccuggaguuuguucauacucagucgaaagaaaagaucuucuuuucugaguuagacgaugaaacccgacaauucguguuugccgagcugaacauccgcggaacacuaaaaauuaaggagaucaaaaagcucauuggccuggaaaccccaguauauuggaaauccaauuucgacgagauagaagguaacagaacgaaucaggugcuuuacaacgucuaucagaacaucgcagaugacuugggguacggauuugauuggucaaagaagcacgcuuucgagauuaaugccgaacugcaggcgaucuuuaaagacgugggcaucgauacugccauucucaacuucgacgcaaguauagaggagaaugacuuugauaagcagaaaagcuaucaacuguggcaccuucuguacuccgcugaagacacagauaaggccaccgaggaagacaaauugaucuacggcaacauuaauacuaagcucaagaaacagcugcaucagaaguauggguucgaggcuaaauacggaaacuuacuggccaauaucucucuacaacaggauuaugguaaccucagcgcaaaggccauuaaaaagauccugcccuaccuugaaucaggcaauaguuucuaugaggcuuguacaauaguuggguacaacccuuccaauagcuugaccaaggagcagcaacagaacaggaaacugaaggacaaacucgaacuguuaccaaagaacucucugcggaaucccguggucgagaaaauccuuaaucagaaggugaacuugauuaaccagcucaucgaugaauauggaaagccugacgagguacgcauugaacuggcgagagagcugaaaaagucagcaaaacaaagggccgaucugaguaagcacaucaaugacgcuacgcucaaaaaccagaauauacguaagacccugcagaaagauuuuggcauucagaacccaagcaagaaugacguuauccgguacaaacuuuacgaugaguugaaagacaacgguuauaagacacuguucacuaauaaauacauuccgaaggaacaauuauuuuccaaagacguggauaucgagcauauaauccccaaggccauucucuucgacgauucuuuuucgaacaagacccuggcauaucgaaaugucaaccuugccaaagcugacgccacagcauucgauuuuaucagcuccaagcaccuggacgauuuggacaauuacaaagcgagaguggaaacucucuuccagucaaagaggauuaguaaagggaaguauaagaaacugcuaaugacccgccagaaccugccugaggauuuuaucgagcgggaccucagaaauucucaguacauagcuaagaaagccacagcaaugcugaaggaagucuucaggagcgugguuccaaccuccggccgcauuacugauaaacuucgagaggacugggauuuggugaacguaaugaaggaacugaauuuacccaaguaucggacgcucggacugacagaguuuaucgaacguaaaaacggcaacaagaucgagcaaauuaucgacuggaccaaaagaaaugaccauaggcaccacgccauggaugcucuuacugucgccuucaccacacauaaccacauucaguaccugaauaaccuaaaugugacccaugggcucaacggaguugacacugaucacgagaagucacgccuguacgcaauaaaacaggcuaucacaaagguguauauugucgguaagacgaaaaagcggaaauuuaucccuccaauggaaaauuucagaagccacgccaagaaccauuuggagggcauucugaucucuuucaaaaauaagaacaaagugguaaccaagaauaagaacaggacuaaaacaaagaccaaagggguguuuaaugaaaagauacaauuaacaccccgaggacagcuccacaaagagacuaucuacggccaugcgaagaagguuauugucaccaaagaaaagguguccaguaaauucacgcacgagaagauccuacaggugaccaaaccggccuaucgcgaggcacuucugaagcgguuggcuagcuuuaagaacgacccuaaaaaggccuucucugguaaaaaugcucucuccaagaacccccuguacuuugauauuacaucagggaaaaaggucccagacacuguuaagcuaaguuauuucgaaaauagcuacgugaucagaaaagaggugaacucggauaacuuuaagaaugaaaaaucccugcagaagguacuugacgucggcauaaggcguauucucgagaaacgccuggccgauuauaacggaaaugcaaaggaagcguucucuaacuuggagaaaaauccuaucuggaaggacaaggagaaaggcgugugcaucaagaaaguucggauugaagcccugaagaacgcugagcccuuacaugugaaaaaggaucaccucgggaagauaauccuggacgacgaaaauaaaagcaccccagucgauuuuauuucaacaggaaacaaucaccauguggccaucuacgaggacaaggaugguaaacuucacgacaagguugugaguuucuacgagguagucuccagagugaaccugggcuugcccauuaucgauaaaucuuuuaauagccaucucgacuggaaguuccuguucuccaugaagcaaaacgaaauguuuguguucccuucagaggauuuuaauccaaaagaaauagacaucgggaacccgaagaauaacgagcuaauuagcaaauaucuguucaggguccagaaguuuaguaaaguuacuuacggaaacucugcagugcgagauuauguauuccggcaccaucuugaaaccgagcucaucgacaagaaggagcugaaaggcauuacguacuaucaguugaaguccaucgguauguuagaaaaacuggugaagguccgcauaaaucacauugggaaaaucgugcacaucggcgaguacuga

SEQ ID NO: 3242 - RNA, 4176 nt, Artificial Sequence
  Cas9 variant
augaagaccauccugggccucgaccuugggacaaacagcauuggaugggcccuggugaaagaggcugaaaaugagaacgaagucuccgauauaaucaaguuggguguuagagugaaucccuuaacuguagacgagcugacgaacuucgaaggcgggaaagcauacucuaauaacgccgagaggacccuaaagcggggagcgcgccgaaaucuccagcguuauaaacugagaagggagaaccuuauugaaauccuguugaagaauggccucauuaacaaggauacagcucugacugagguggguaaagaaaccacacaccaaacccugaagcuccggucaaaaagugccaaugagaaggucagcuuagaggaccuggcaaaaauccuuuuguccauaaacaagaagcgcggguacaaaucuucgagaaaggugaaugccgaagaugacggaguugcuaucgauggcauggagguggcaaaacugcuauaugacgaaaacaugacuccuggcgaguacguccucaggcugcuugaaucagggaagaaacaucugccagauuuuuaucggagcgacuugcaggaggaguucaaucucguguggaagaaacagagugaauuuuacccgcugauuuuaacaaaggagcuguucuuugaacuccacggaaagaacaaaucccagaccugggccaucugcaaggagccccuugguauuguaggcguuaaacugaaggggucugcuaaagaacaaaaguucgcccgcuaucgauugagaaaggaggcgcuaacgcagcagaucgagcuggaacaucucgcaauagugcugcaggauauuaacaaugacagcaacaaauccucaggauaccuuggcgccaucagugauaggagcaaggagcuguuuuucaauaaagaaacugucggucaauaccaguauaagcaguugcagaaagacccuaacaccucucucaagaaucaaguguuuuaccggcaggacuaucuggaugaguucgaagugauuuggcguaaccaggcuaaguuuuacccacaauuaacaaaugagcugaaacaggagauccgcgacgucguuaucuucuaucagagaaagcuaaaaucccagaagaaccucauuucauuuugucaauucgaaagcacucagcagaauuacguggagaaagaaaccgggaagacaaagauaaggaccaucggacggcgaguaauuccccgcaguucuccucuguuccaggaguuuaaaaucuggcaaucccuuaacaauuugaaguucgugaacagcgagucgaaucagauaauucaguuuaucgaacuggaggaugacgucaaaaaggugguuuucgaugaacucaaccugagaggcgaccuuaaaccaaaucaggugcugaagaucuugucuaaauauaugaagauuggcaagcucacgcaauggaaaugcaaccuggaggaaaucgaggggaacaggacuaauuccgccuuauacaacgucuuucagaugauugcagaggaagagggauacgguuucaauuggggcaagaaaucagcucuggaaauaaagagugagcuaaaagccaucuuuagcuccauugggaucaacgauucuauccucgacuucgauuuuagcaagaagcuggaccagcagcuuucauaucaauuguggcaucugcucuacagugcggaagagggaaauuccaaaauuacagaggaagauaaguucaccuauggcaacacugguguggcccugaaaaagaaauuacaccugaaguuuggguucaagcccgaguacagcacacuuauaucuaauuugcgguuuaccucagacuauggcaaccucaguagcaaagcaaucuccaagauucugccuuuccuacgcgacggaucugauuacucgaaggcuugucaguaugccggcuacaaucacagcaacucccugucagcugacgaacucgauaauagagagcugaagccaaaacuugaauugcugaagaagaacaguuuaaggaauccgguaguugagaaaauccucaaccagauggugaaugucgugaaccaagucauugacaacuacgggaagcccgaugaggugcguaucgaacuggcccgggagcuuaaaaagucugcaaaagaacgaagccagaugacgaagaauauauccgacgccaccagaaggaacgcugagaucaaaaaguaucugucaaaggaguucgguauuccuaauccaacaaaaggagauguuauccgcuaccgguugugggaagaacucgcgagcaacggcuauaaggaccuguuuagagauaaauacauucccaaggaaaaacuauucucuaaugagaucgacauagaacacauuaucccuaaggcacugcucuuugaugacuccuucaguaacaagacucuggccuuuaaaguggauaaucuuaagaaagcugacaggaccgccuucgacuuuaugagcacagauuucucuaaggacguagauuccuauauugggcgcaucgagacuuugcauaaagacggaaagauaucaaguagcaaguacaaaaagcugaugaucccaaaaucgaaguuagucgauggcuuuauugagcgagaccuccggaacacccaguauaucgcaaaacaggcccguaagaugcugcuugaaguguucaagacaguugugcccaccacugguaaaauuacggauaagcugagagaggacugggaucuaaucaaugucaugaaagaacucaacuuuccgaaguacaaagcucugggguugacaaagaagauagagagguucgacgugggcuccgaaaagauuaagucuaucaauguaaucgagggauggagcaaacgcaacgaucaccggcaucacgccauggacgcacuggcgguggcuuuuaccacucacaaucauauucaauacuuaaacuaucucaaugccagaaaggauauccaccaugagaugcacggcaccauuaaaucaauagaaaaccagaucauugggaaggacguuaugggaaaaaggcgauucaucccucccauuagugaccugcgcaugaaggcaaaacuucagaucgaguccauacugaucucuuucaaaaacaagaauaaagucgugacauggagcgugaacaagaccaaauugaaggguaaggauaauuacaacaaacggagacagcucacuccaaggggccaacugcauaaggaaacagucuaugggaaaauuaagcuaaucgacccuaaaccccugaaacuuaauaacaaguuuacgcucguucgugccuccaugauuguggauaaagugcaccgcgagaucguacugcagcacuugucaaaguacgacaauaacagcgaagucgcuuucgauaguaaaaccauaaagauugacccaauccugaucgagggaauuggcuuaaaagaggugguuugcuaugaagauguguuuaagauacggaagaaaaucucuggugacaauuucaagaacgagaaacaucucgaaaaggucauugaugagaaagugaagcagauccugaaagacagaguuauuaaguuucaggggaauuucaaggaggccuuuuccaaccuugaagagaaucccaucuggcugaacaaaagcaagggcauagcagugaaaucgguagcuaucaagggagucaauaacgccgaaucauugcacgagggcaaagaucauuucggggaccaaauucucgacaagaauaagaaacagaucccuguggauuuugugucuacuggaaacaaccaccacgucggcauuuacgaagacaaggaugguaaucugcaggagaggguugugaguuucuuugaggcgguaacacgagugaacgaagggcuaccaaucauagacaaaaccuauaauuccgauauuggauggaaguucaaauucacaaugaagcaaaacgagauguuugucuucccgagcgacgauuuugaccccaaugaguucgaucugacugacggcaagaacgccgcuaaaaucucuccuaaucuuuaccgggugcagaagaucgcaaccaaaaacuacauguuucgccaucaccucgagacgguugugaccaaugaucuggaguucacauauaagagcauuagauccacugguugguugaggaacuuagucaaagugcggaucaaucaucugggcgaaauaguuuacgugggggaguauuga

SEQ ID NO: 3243 - RNA, 4176 nt, Artificial Sequence
  Cas9 variant
augaagaaaauccugggccucgaccuugggaccacaagcauuggaugggcccuggugaacgagaaggaaaauaacgaggaauuguccucuauaaucagauuaggugucaggguuaauccccugacuguggaugagaaaucaaacuucgaaaagggcaaagacauuacgaccaaugcugaucggacaaagugccgcagugcacgacguaaccuacagagauuuaagcucaggcgggaggcccuggcggacugucuuaaacgccacgggcugaugacugaugagaccccuuugugcgaaacaaauaacagcaucauuuucaagaccuacuccaauagagcuaaagccguaugugagaagaucgcacucgacgauuuugugaggguccuguucaugauaaacaaaaagcggggauauaagucuucgcgcaaacugaauacugacgaugaaggcacacucguggacgguauggauguugccaaguuacuguacaacgagcaaaucaccccaggggaguaucuuuugcgacuguuuaaaaagggcaaaaagacgagaccggacuucuaccuaucagaucucaaagcugaacuggagaggauuugggacuuucagcggacuuucuaucccgaaauccuuugcaaugcacugaaggaggacuugaagggaaaaagccguacccagaguuccgccaucuuuuacgcuaaguauaaagugucuacagccaagauugcgggcaaagauaagcgccuccaggaacugacuuggagaaccgacgcauuaaggaagcaacugacaauagaugaggucgccuacgugauuuguagcaucaacggggagguaaauggauccucacagcggcucaguaugauuagcgaccgaucuaaacuucuguacuucaaccaucagaccaucggucaguauuugaugcaacgccuagaagagaacccuaaugcuggccugaagaacaucauauuuuacagacaggauuaugaagacgaguucaaugauauuuggaacucccaggccacguaccacaaagaacucacuccagagcugaagaaagagguuaaggacaucaucuuuuaucagagggggcuuaagucaugcaaauggcugauuaauuacugugaauuggagcaugaagagauagaagugaagacacccgagggaaaacuccggaagauuaccaucggcagcaaaacuugcccuaagaguucuccacuguuccaagaguucaagaucuggcaggucuuaaacaaucuacaggugagcccccugaacucccgcagaaaagcaaagaggaaaaaggaugaggaaccuucgcucuuuucugacgaagauaugaauacagcuugucguuaucugaacgaggaggaaaaacuuaccuuguucaaggagcuguccauuaaaaaggaacucaagaaaaaggacgcccugaaacuucuguuugagaauuacaaggaauuggaccucaacuacaaagugaucucagguaaugucacgauggcgaaccuguaucgggccuuccaagauauuauaaguuuaaccgggaauggagaguuugacuuccaggcaaugccagcugaggaagccgagaagacaguugaagagaucuuuggcggccugggguacaagacugcuuuccuacacuuugaugccagccuccaugacaaagaguucgaacgacagccggcauauagacuguggcaccuuuuguacuccuaugccggagaucagucuaagaccgguauugaggcucuggugaaaaggauccaagaacucugcggcuuugagcccgaauacgcgcgcauccuggcaaacauuagcuucauaccugacuaugggaacuuaucaaguaaggccaugcggaaaauccugccauacaugcaggauggauacgaguauuccgaagcauguagcaaggccggcuacagacacucugcaucaagucuuacaaaggaggagauuaauaaaaagaacuauaaaacucauuuggacgaaaucaagaggaauagccuccgcaaccccauuguagagaaaauccugaaucagauggugaacgucguuaauuccgugauagauaccuacucuaacaucgacgaaauucgaaucgagauggcccgggagcuaaagaagucgaaaccugaacgugaggauaugagcuuugcuauuuccaaggccacaaaagaaaccgagagaaucaaggguauacuggaacaggaguucaaaauucaacacgugacuaggaaugacaucauucgcuaucggcucuacgaggaacugaagccaaacggguauaaaacgcuuuacucaaauacauacauccccagagaggauuuguucaguaagaaguuugacauagaacauaucauuccgaaagcaaggcuguucgacgauucuuauagcaacaagaccuuagagcuccgagacaucaauauugaaaaaggcaaccagacugcguacgauuuuguccuguccaaguauggagaggagggccuuuacaaauaugaacagcgcguggaggaguucaagaagaauaacgaacaggcugggaccaaaugccggaagcuguugaugagagaagccgacaucccuucagauuuucucaacagggaccugaaugauagccaauacauagcuaaaaaggcccacgagcuacugcgugagauuguacccacaguuaccgcuacuacaggaucuaucacgaaccgccuccgggaagacuggaaacuggugaaugucaugaaggagcuuaacugggaaaaguaugauaaauugggucugaccgaggaguacaaggacaaagauggcaauacugugagacacaucaaggacuggacaaaaaggaacgaucaucgacaccaugccauggacgcauuaaccauugcuuucacaaagccauccuuuauccaguaccucaauaaccugaaugcccggaguaaccgcgggggaagcauuuauggcauagaacagaaggagcuugaaagagagaauaacaaacuggucuucaucccucccauugacccaaagaucuuuaggaaacaggcgaaggaacaccuaucuaauauucucaucuccauaaaagccaagaacaaggugguuacuaaaaaugugaacaagaccaaaucaaagagugguacgaaccggaaaguacaacugacaccccgagggcaguugcaucuggagaccgucuacggcaagaucagaacuuauaaaaccgaggaaauuaaggugggaacaaaguuaacugaggaacucaucgcuaaaguugcagauaagaaaauucgcgaggcccugaugcagaggcuuagcgaauacggcgggaauaucaagaaggcuuuccaaaacauaucgaaacacccuauuuggcugaauggaucccacaccaagcaugugccagagaaagucaagaucguguuuuucgaggacguauuuacgauccguaaagccauuacaccggauauaaagaucgacaaagugauugauucuaagauccggagaauuuugcaggaaaggcucaacgaguucgguggcgaagcaagcaaggcguucucaaaucuggacgagaaccccaucugguuuaaucgcgauaaagggauagccaucaagaguguuaaaauucgaggaaucgcuaagggcaccgccauuagagucaaaaaggacauccacgguaagacuauaauugggaacaauggcuauccuguggcaaacgauuacgugaauacaggaaacaaucaucacgucgcuaucuuccgggacaaagauggcaaccuacaggaacacaucguuuccuuuuaugaggccaccgcaagggccauucagaaucugccaaucguggaccgcaacuacaauucugagaaggacuggaaauuccuuuuuagcaugaagcaaaacgaauacuucguguuucccaacccuaauacuggguucaacccauccgagauaucacucaaagaugaaaagaauuaugcucugauuagccccaacuuguuucguguacagaaacugagucauuacuauuacgucuucagacaccauuuagagaccaauguggacacaaaccuccagcugaaggauaucacguggaagcggauuaccgcgguuaauaaccuuacuggagccgugaaagucaggaucgaccaccugggccgcauaguggauguuggugaguauaaguga

SEQ ID NO: 3244 - RNA, 4176 nt, Artificial Sequence
  Cas9 variant
augaagaacuaccacaucggccuggacauugggaccagcuccgugggauucgccgcuagagaugacgauaauaaccucauaagggucaaagguaagaauguuaucggcgcacggcuuuucucugaggggcagacagcccaagaacgccgaauggcgcguacuucaagaaggcgguauaaccgcagaaaauggaggcugcgguuguuagacgagauuuuccaugaugaaaucauucacaaggacgcugaguuuuucaaucgccugaaacagaguuuucuaagccccaaggaugaacgaaagcaguacuucggaucccuccuguuuccugagacgggcgacucugaguauuaccauaacgguaaucagaccaucuaucaccuuagacauaggcugauaacacaagaugaaaaagccgacauccgggagauuuacuuggcacuccgucacaucauuaaguaucgcgggaacuuccuggaugacacuccagugucgucauuugaagccagcgaucugaaacucgcuaguuucguaccgaccaucaaugacuuauuugagacaauagacgugaacuacgaguucuccauggauaauauuaacgaaaucgaggacauucugcuuaauaacaaguugagaaauucugauaaaagcaagcagcugaccgaccuacucacugaacccaucgucaacaucgaugacaagucccuggagaaacaguuuaacaaggaaaggacagauauuucaaaagagauagcaaagagugugguuggaagcaaaaugaaugugaacaaacuucugucuuucgaguccucagaaggcagcaaaaucgccuucaguuuuucugacgcuuccagcgaggauaagaugauggaauugucggacauucucgaugacucucggaugaauauccugaacauauuaaaggucauuuacucccgagugcgccugaaucagaucaucccuucaggcauggggcucagugagagcaugguagccgcguaugacucccacaaacaacagcuuaaggaucugaaaaccuugcuaaacguucugccauucaaugaaagauacgcagugaagauugccuaugcugccuacaucggaaacauugacaaacagaaguuuacgaagucugagauaaaagcaaucgauaagcucaaagaaaagagcgcuauuaugaauguccuggacuucaaaucaggucauaucacuaacgaggagcuuaguaaugugaucaaggccgugauugucgauaaguaucugaacgacgaagauuuugaguaccacggcauaguugaaaagaucaaucaggacauuuccaacgggagcuauuugcucaagcaaaggaauaaccagaacggaaauaucccccaucagcugcaccaaauggaguuagaucagauuaucgagaaccagucuaaauacuaccacuuccugggcgaacuaaauccuaacucaaaucggaaccauauagcgaaguauaaaaucagugagcucguggccuuucgcguaccauacuauguggguccccugauuaccccugaggagcaggagaagacaagcggggcauccuucgcuuggaugaagagaaagaaggacggagccaucacuccauggaauuuugaagagaaagucgauaaggaagagaccgcuucuagguucauuaaacgucuuacagugaaggacaccuacuugcugaacgaagauguucucccggacaauucgcugcuuuaugagaaauuuaaggugcugaacgaguugaaugucgugaaggccaacaauaaacggcucacgguagaagagaagcaaggcgcauucgacaaccuguuuaaaaagaugaaaacuguuacagccaagcgauuaaagaauuaccuggugagcaaccacaaccauaucaauuccgucgaaauaaccggccuaucagauggggacaaauucaacaauagucucucuacuuauauugauuucaagaaaaucuuuggagacaagauugauaaccccggucugcuugacgauuucgaggacaucauagaauggagcacaguguuugaggauagaaaaaucuucgaggaaaaggucaggaaggacauuuccuggaucucagagagcgaaauuaaaucugugguuuccaagcgcuacaguggcugggggcgguugagcaaaaagcugcucaauugcaucaccaacaaugagggaagaaacauaauugaugaacugugggaggagucugaaacguuuauggaggcuguguccaaaccugaaguaaaggagcagaucgacggcaucaauucagauuucauuaagaacaccgacaucgagagugucuuagcggacgcauacacaagcccacagaauaaaaaggccauuagggaaacucacaaacuggugaaggauauacagaaagcuaugggugggcaagcccccgcaucgaucuccauugaguuuacccgcaacccucaggacaagggccagcuuacacgaucucggcauagcgaaguuucacguaaauauaaggagaucaguaaggaaauuuccaaaacuuugaaugaugagcucaagucuaaaaagaacagcauggacguggauaaauacuaucuguacuucaugcagaugggaaucgaccuauaugauggcuccucaauagacaucgaugaccugaauaacuaccaaauugaucacaucauuccacagagcuuuuauaaggacgacaguuucgauaacagaguccucacccacuacucuaauaaccagaagaaagggaauaacacaccccugaauggacuuaacaucaaugacaagaccagggccauauggaaccauuugcgcgaucuggguuuaauuacuaaaaagaaauacaauggccucacgcugaaggggauggaccagcuuuccaaguauacaaaacacggauuuauccggagacaacugguggagaccagccagguaaucaaguugguggcuaacauucucucggaugaauuuucaacugacgauaccaaaauaaucgagguuaaggccaaaaugaacucucagauuaggcaagucuuuaaucuguacaaggugcgagaacuaaaugacuaucaucacgcaguggaugcguaccugacaaccuucaucggcgguuaucucuacaaccgcuauccgaaucugcggaacauguucgucuacggggacuuuaagaaauucagugcugauguugacaaucuuaagacuuuuaacuucuugcacgagauuacaaacccuuccgauaaauuugaagacagaaucuucgacgaaaagagcggcgagcugauauuagauaggaaacaugccaucgaaacgauuaagaagaucuaccaguauaaauacaugcucauuacccgugaggugucuacuaagaauggacagcugagcgaccagacaguguauuccgcaaaacgcaucaacaauguaaaggcccccauaccagucaaaaaggauuuuaacccugaacuuuacggcuuccggaccgggaauguggaccaccauaugguuauugugaaauaucccaagaaggauucauacgacuauaaagucgugggaaucccacugagauuuguucaaaagcuaaaagagacaaaggauaacaaagacuacgaaaaucuccugaaccagaucgugcagaugaaguugaauaggaagaaacaggauuucauuguagucguggacaacgugauguacggucaacugauccaggauggcgggcagaaguuuacuuuaggaaguagcaccuaucgauacaaugcuaaacagcucgucauagacaacggcuaucugaaacuuauugccgaugagcgguacaaaaauucucugacggacgaggaaaaguccaaccaauauaucaccuuguacaaugagauucucaagguugugaacggucgcuucgacguauucgaugugaacucauuuaggaaaaagcugaauaacggggucgacaaauucaucaagcuaaauacaguggauaaaagaauaauuaucaugaagauccugaguggccuucacuguggacccagcauuguuccucucaaggaacugggcuugacuaccccacuggggcaguuacaguccacaucuggaaucucgcucagcgagaacacuauuauaaucuaucaaucaccguccggccuguuugagcggaaagugcgacuuggugaccuguga

SEQ ID NO: 3245 - RNA, 4176 nt, Artificial Sequence
  Cas9 variant
augaagaacuaccacaucggccuggacauugggaccagcuccgugggauucgccgcuagagaugacgauaauaaccucauaagggucaaagguaagaauguuaucggcgcacggcuguuuucugaggggaaaacagcccaggaacgccgaauuucacguacuucaagaaggcgguauaaccgcagaaaguggaggcuucgguuguuagacgagaucuuccaugaugcgauugugcacaaagacgcugaauuuuucaaucgccugaagcaaagcucccuaucucccaaggaugagcgaaaacaguacuuuggaucgcuccuguucccugaaguaggcgacggugauuauuuuagagacgggaaccagacgaucuaccaucuuaggcaccggcugaugacccaggaugagaaggccgacauacgugagguguauuuggcacuccgccauaucauuaaauacagaggaaauuuccuggaugacacaccagucaguagcuuugaagccagugaccugaagcucgcuuccuucgugccgacuuuaaacgaucuguuugagaccaucaauguuaacuaugaacuuucuauugacaaugugaaccaaaucgagaauauauugcugaacaauaaacuaaggaacagcgauaaguccaagcagcucacagaccugauugcagagcccgucaccaacaucgaugacaaaucacuuaagaaacaguucgauaaggaacggaaagacauuaguaaggagaucgccaaagcugugguaggcagcaagaugaauguuaacaagcuguugucuuuugaauccucagauggcagcaaaaucaguuucucuuucuccgacgccagcucggaggauaagaugcucgaacugucugacauuuuagacgauucccgaaugaauauacugaacgugcucaaagucaucuacucacgcgugagacuuaaucagauuaucccuagugggaugggacugagcgaguccaugauagcggcauacgacuugcacaagcaacagcuaaaagaucugaagacucuccuggacguggucccauuuaacgagaaguaugccguuaaaauugcuuacgccgcauauaucgguaauaucgauaagcagagguucacaaaagcugaagugaagaccauugacaaacuucgggauaagaagucuaucacgagcguacuggacuuuaaaucaggccacauuacuaacgaggaauugaauaacgugauaaaggaggucaucguggauaaauaccucaaugacgaaaccuucgaguaucaugauauuguugagaagaucaaccaggacaucaguaaugggaacuaccuguuaaaacaacgcaauaaccagaacggaaauauuccccaccagcugcaucaaauggaacuagaucagauaaucgagaagcaguccaaguauuacccuuuucucggcaaacugaacccaaauagcaagagaucucacauugccaaauacaagaucucagaacuuguggcguucaggguccccuauuacguggguccuuugauuacaccagaggaacaggagaaaaccaguggggccagcuuugcauggaugaagcguaaagaggacggagcuaucaccccguggaacuucgaaaagaugguagacaaggaguccacagccucucgguuuauaaaacgacugaccguuaaggauacguaucuccugaaugaagacgugcuucccgauaacucgcuguuguacgagaaauucaagguccucaaugagcugaacguggucaaagcuaauaacaagagauuaacuguggaagagaagcaaggcgccuuugacaaucuguucaaacagaugaagacaguuaccgcaaaaaggcuaaagaacuaucucgugagcaaucacaaccauaucaauuccguaaaaauuacuggccugucagauggggaaaaguuuaacaacagucuuucugucuacaucgacuucaagaaaauuuucggagauaagaucgacgauagcaaauuguuugacgauuucgagaauauaauugaaugguccacaguguuugaggaccgcgauaucuucgaggaaaagguucggaaagacauuucauggaucagcgagucugaaauaaacgccguggucuccaagagauauagugguuggggcaggcugagcaagaaacuccugaaugggaucaccaacgacgagggacgcaauauuaucgaugaauuaugggaggagucugaaacguuuauggaggcuguguccaagccugaaguaaaagagaagauugacgaaaucaacucaaauuucauaaagaacaccgauauugagagugugcuggcggacgcauacacaagcccacagaauaagaaagccauccgagagacuuacaaacuuguuaaggauauccagaaagcuaugggcggucaagcccccucguccauuucuaucgaauuuacccggaacccucaggacaagggggaguugacacguagcagacacucagaaauugccaaaaaguauaaagagcucaguaaggaggucuccaagaaacugaaugaugaacuaaagucuaaaaagaacagcauggacguggauaaauacuaucuguacuucaugcagaugggcauagaccucuaugauggaacuuccaucgacauugacgaucugaauaacuaccagaucgaccauauugugccacaaucauuuuauaaggaugacagcuucgauaauaggguccuuacccacuacaguaacaaccagaagaaaggcaauaacacacccuugaaugggcugaacaucgacucuaauacccgcgagguuuggaaccauuuaauaggacucggucugaucacuaagcggaaauacaauaaccuuacgcugaagggcauggaucaguuguccaaauauacaaagcacggguuuauuagaaggcagcucguggaaaccagccaagugaucaagcugguagcaaauauucuaucggacgaguacucaaaagaugacacuaagaucauagaagucaaagcuaagcugaacucucagauucgacagguguucaaucucuauaaaauccgcgagcugaacgauuaccaccaugcccuugacgcauauuugaccacauuuaucggaggcuaccuguauaaucgguacccgaacuuaagaaauauguucguuuacggugauuucaagaaguuuagugcgaaaauugacaaccucgagaccuucaauuuucugcacgacauaacuaacccuuccgauaaguucgaagacaggaucauugaugagaaaagcggggaagugauccuugaccgucgccaugcuauugagacaaucaagaaaauauaucaauacaacuauaugcugaucacgcgggaagucucuaccaagaauggccagcuaagcgaucagacuguguacuccgccagaaggauuaacaaaguuaauucacccaucccagugaagaaggacaguaacccugagcucuauggauuucgaacaggcaauguagaucaccacauggucauugugaaauaccugaacaaggacaaauaugauuacaagaucauagggauucccuugcgguucgugcagguccugaaaaauagcaacgacaauaccgaguacaagaacaucuuaaauaagaucguucaaucuaaacucaagggaaaauccacagauuuucgcgugauucuggacaacguaauguauggucagcuuauccaggauggcgggcagaaguucacucugggaucaaguaccuacaaauauaaugcaaagcaauuggugauaaacauggacgacauuagaauccucgucgauaauagguacuuuaacagccuguccgacgaugacgccucuggcgaguucauuaagaucuauaacgaaauacuaaaagugauuaaugcucgguuugaucuguucgacaucaacaaguuccgagaaaaacuuaauaacgguaaggaguacuuugaaaaucucucgaucgaugagaaaaaccagguucuguugaagaugcugagcggguuacauugcggcucagccaaugugccaauuaaggagcucggacugacgacuccccuuggcaaacugcagaucccuuccgggauugucuugagugaagacgcaauagugaucuaucagucuccaagcggacucuucgagagaaagauucgccugaaagauaucuga

SEQ ID NO: 3246 - RNA, 4176 nt, Artificial Sequence
  Cas9 variant
augaaccugagaaauuaccccggcgaguauagcaucgggcucgacaugggaaccgguuccgugggcuggucugucguugaugaaaaggggaaccuucugcacuucaaaaagaaaccuacauggggaucaagguuguuugacagugugaugccagccagcgaggcucggguacaucgcggccagcgacguagauacgaaaggcggcgcuggagauuagaucugcuacaaggucucuucaagaaugagaugaacaaaguggacccggaauuuuucaugaggcugaaucagucccggacuauugagggggaucccauauuuacgaagucuuucaccaaggcagacuauuacgaucgcuuuccuacaaucuaucaccuucgagccuaccugauggagucgaacgaaccagcggacuugagacucauuuaucuggcuaugcauaauaucauuaaacacaggggaaacuuccugcgggaggaagagaagucacucagcgccaaacaugcagauaguaagaaagccgucacucaguuuguggacgcuuuaaaggaguggugcuucucccguggcuacgaauuuggcaaggaucccgcaaaaucuaucgagaagugucugagcgacuccaaaucaagucgcagccagcuugccucugaaauagcuaaggccuuggcgguuuccaccgaugcagccgcugccgacaaaaagcuggcagacaaucuagcuaaagccaugguggggcuccaaugcgaguucaaguacgucuuuggagaauuugauugugagucaacaaagcuggcgcuuagcgacgaugagaaacuggaauugcucagagccgcaugcccugacgauaguguggagcuguuagacgcucugugugccguauauucugcuuacguucuccagggucuucuguccuaugccccaggccagaccaucagccacaacaugauugcaaaguacgauuuguauaaaacugaccuaaagacacugagggcccucgugcgggaauacgcucccggggcguaugaugaguucuuucgaggagcaaccuaccacgacgccaauccugaugacucgucuaaagacuacuccuaugcugaugccgaaggcuacacggcauauaaccugcauaaguugucauacgacgauuucgccaaggcugucaaaaagcuguugggugggacugacgccgugaccgaugagcgcuaucucaauaugauggagagauuugaaaaacagcaauuccugaggcgguuaaagacaagugacaacggagcaaucuacuaucagcugcaccuagaggaacucacugcgauuaucaaaaaucagggccgcuuuuacagcuuccugaaggaguacgaaggcaaguuugagucccuugugucuuucagaauaccauauuacgucgggccguugaccagcguuaacgcugcccaggauucacauaaccacaauagguuucaauggagugagcguaaacccggaauggaacgggaggugauuacaccuuggaacugggacaccaucauugauaagaauaaauccgcagaaaacuucaucaugcgaaugacgggugacugcacuuaucuggccggcgagaagguacucccaaaacagagccugcuuuacgaggaauuuugugugcugaaugaguugaacggggucagauggucugaugacggagaugacuggcagagguucgacgcugcccaacgcgaaggcaucgugcgggagcucuuucacaaguauagaaggguuacauacaagaugcuggaagauugguuagugcgcgagggugacgcaaaucaucccauugucaaagggggccagggagagaccggccuggaaucaaagauggggaguuaucuauucuucgcuaaaggaauauuuggucucggcgagcugagcccugccgaauacccagcgaucgagaagaugauuaaauggaacacucuuuucgaagaucgauccaucuugaaggagaaacuggaggacgaauuuggggagcggggaaauggcaugcucgaugccucucagauaaaggcuauuugcaagaaacguuucacagguugggggagacugucggaacaguuuuuaaccggccugaagguggagagccccgcaggaagggccguauccaucauggacguucuucgcgaaggcaacccguguucagagcggagacaaggggagacgguggucaugauggaagcucuuagggaugagggacucgguuuccagaaaaagaucgacgaacacaaucgaaacuacuauggccagcaugggaaagaucugggagugaaugagcuaccuggcagucccgccauucgccggucucugaaccaggcaaucagaauugucgaggaaauagcgagcaucgccggucacgcuccagccaauauuuuuaucgaggugacccguggggaagacgcaggcaagaagggaaaaaggacaguuaagcgcugggauaaaaucggcgaggcucucaagaaacugaaggaagaggggguggccguagaggucauggacgauuucaaggaacaaaaagcaauuaacgccaaccuugacgagcgguugucccuguacuuaaugcagaauggaaagugccucuauucaggcaaagcuauaaaccuggaaaaacuucuggcggguagcggggaguacgaaguggaccauaucauuccuagagccuauaucaaggaugacucuauugagaauaaggcauugguucucagggaggaaaaccagcacaagacugaucagcugcuaaucgacaaauccauacgauggaagaugcgggagaccuggagucaacugcacgaugcuggacucaucggcgacaaaaaguaccauaaucugcuucgcagcaacauuaaugaaaaccaguugagagguuuuaucgccaggcagcugguggagacaucucagauggucaaauuagcccaagcucuccuggaagcacgguucgccaaugaggagacucgaauugugcccguaaaggcguccaugucacacaaccuuagagaagcugccgaucuggcaaaaugucgcgaggccaaugacuuucaucacgcucacgaugcauuccuagccaguaggaucggccucuuugugcagaugcgucauccagggauauaugaaaaccccauuggauacagccacguuaucaagaaguacguccaggagcaaucggagguguucaaaaagacccaucggaugccuggcuccgcgggguucgugauuaauucuuuuaugagcucaggauucgacaaagauacaggcgaagucuuuaaggacaguugggacgcugaggccgaaguugaugguaucagaaaagcacugaacuauaggcagugcuacauaucccgcaugccacagcaggacaccggggccuucuggaaugcuacuguguauucuccgcgagaucccaagaugggaccuaaguuggcccugagcacgaaacaaggcuuagacccaaagcucuacgguggcuuuuccucacagcaguucgcauauuucuucaucuacgaggcuaaaaagaaagggaagcccacauuuagauucagccaggugccuguauggcuggccgcgcggauugaagccaacccacuugcacuggaggaguaugcuaggggauuggccaagggcgaagggcucgaguuugucaguauccaacgccccaaaauuuacaagaaacagcugaucgaagugaacggagauaagcuaauaauuaccggcgcuaaagagguucguucuggugcagaacuggccuucaaucaggacgagaucuccgccaucagcaugugcucgaaacuuagagcugcggaggcagggcucgauggagccuucucagaagaggugucugcuauuuggaaccggaucaguaaugccccgguccaguccuguggcaggcuguugcgccaacugacuuuaccuaaguaccagagcaacuuugacucuagcuccaaugaagagaaggcagccgugguucucggucugauugcgcuucugaacggcaauaaccgaauaguggauuugucagggguaggaggcaguagccacgcuggggccaugaugaugucuuauccaaagcuccuggacgaucccaaagucccuuucuuuaucauugaccaguccgugaccggaauguucgaaagaaagacacgggugggccuauga

SEQ ID NO: 3247 - RNA, 4176 nt, Artificial Sequence
  Cas9 variant
augaagaaaauccugggccucgaccuugggaccacaagcauuggaugggcccuggugaacgagaaggaaaauaacgaggaacaguccucuauaaucagauugggugucaggguuaaucccuuaacuguggaugagaaaucaaacuucgaaaagggcaaagacauuacgaccaaugcugaucggacaaagugccgcagugcacgacguaaccugcaaagauuuaagcuaaggcgggaggcccucgcggacugucugaaacgccacgggcuuaugacugaugagaccccucugugcgaaacaaauaacagcaucauuuucaagaccuacuccaauagagcuaaagccguaugugagaagaucgcauuggacgauuuugugaggguccucuucaugauaaacaaaaagcggggauauaagucuucgcgcaaacugaauacugacgaugaaggcacacugguggacgguauggauguugccaagcucuuauacaacgagcagaucaccccaggggaguaucugcuucgauuguuuaaaaagggaaagaagacgagaccggacuucuaccugucagaucuaaaagcugaacucgagaggauuugggacuuucagcggacuuucuaucccgaaauccugugcgacgcacuuaaggaggaucugaagggcaaaagccguacccagaguuccgccauauuuuacgcuaaguauaaagugucuacagccaagaucgcgggcaaagacaagcgcuugcaagaacucacuuggagaaccgaugcacugaggaagcaguuaacaauagacgaggucgccuacgugauuuguagcaucaauggggagauuaacggauccucacagcggcugaguaugaucagcgaucgaucuaaacuccuuuacuucaaucaucagaccaucggucaauaucugaugcagcgcuuggaagagaacccuaacgcuggccuaaagaauauuauauuuuacagacaggacuaugaagaugaguucaacgacaucuggaacucccaggccacguaccacaaagaacugacuccagagcucaagaaagagcugaaggauauuaucuuuuaucaaagggggcuuaagucaugcaaauggcugauaaauuacugugaauuggagcaugaagagauugaaguaaagacacccgagggaaaacuccggaagaucaccaucggcagcaaaacuugcccuaagaguucuccacuguuccaggaguucaagauuuggcagguuuuaaauaaccugcaagugagcccccuaaauucccgcagaaaagcaaagaggaaaaaggacgaggaaccuucgcucuuuucugaugaagacaugaacacagcuugucguuaucugaaugaggaggaaaaacuuaccuuguucaaggagcuguccaucaaaaaggaacucaagaaaaaggacgcccugaaacuucuguuugagaacuacaaggaauuggaucucaauuacaaagucauuucagguaacgugacgauggcgagucuguaucgggccuuccaggacauaaucagcuuaaccgggaauggagaguuugauuuccaggcaaugccagcugaggaagccgagaagacaguggaagagauuuuuggcggccugggguacaagacugcuuuccuacacuuugacgccucccuccauggaaaagaguucgaacgacagccggcauauagacuguggcaccuuuuguacucuuaugccggugaucaaagcaagaccggcaucgaggcucuggucaaaaggauccaggaacucugcggguuugagcccgaauacgcgcgcauucuggcaaacauaucauucaucccugacuauggaaauuuaaguuccaaggccaugcggaaaauucugccauacaugcaggauggcuacgaguauagcgaagcauguucuaaggccgguuacagacacucagcaaguagccuuacaaaggaggagaucaacaaaaagacuuauaaaacccauuuggacgaaauuaagaggaacucccuccgcaaucccaucguugagaaaauacugaaccagauggugaauguagugaacucugucaucgauacauacgggucgauugacgaaauccgaauugagauggcccgggagcuaaagaaaagcaaaccugaacgugaggauauguccuuugcuaucaauaaggccaccaaagaaacugagagaauaaagggcauucuggaacaagaguucaaaauccagcacgugacgaggaacgacauuauccgcuaucggcucuacgaggaacugaagccaaauggauauaaaacacuuuacucaaacaccuacauacccagagaggauuuguucaguaagaaguuugacaucgaacauauuaucccgaaagcaaggcuguucgacgauucuuauagcaauaagacuuuagagcuccgagacauuaacaucgaaaaaggcaaucagaccgcguacgauuuuguucuguccaaguauggggaggagggacuuuacaaauaugaacagcgcguggaggaguucaagaagaacaaugaacaagcugguucaaaaugccggaagcuguugaugagagaagccgacauaccuagcgauuuucucaacagggaccugaaugauucucaguacauugcuaaaaaggcccacgagcuacugcgugagaucguccccacagugaccgcuacuacaggcuccaucacgaaccgccuccgggaagacuggaaacugguaaacguuaugaaggagcuuaauugggaaaaguaugauaaauuggggcugaccgaggaguacaaggacaaagauggaaacacugugagacacauuaaggacuggacaaaaaggaaugaucaucgacaccaugccauggacgcauuaaccaucgcuuucacaaagccaaguuuuauucaguaccucaacaaucugaacgcccggagcaauaagggcgguucuauauaugggaucgaacagaaagagcuugaacgcgagaacaauaagcuggucuucauuccucccaucgacccaaaaauuuuuagaaagcaagcgaaagaacaccuauccaacauccucauaucaaucaaggccaagaauaaaguggucacuaagaacgugaauaaaaccaagaguaaaagcggcacgaacaggaagguucagcugacaccccggggacaguugcaucuggagaccguguacggcaaaauucgaacuuauaagaccgaggaaaucaagguagggacaaaauuaacugaggaacucauugcuaaggucgcagauaaaaagaucagagaggcccugaugcaacgccuuucggaauacggagguaauauuaaaaaggcuuuccagaacauuuccaagcacccuaucuggcugaacucuagccacaccaaacaugugccagagaagguuaaaaucguguuuuucgaggacgucuuuacgauuaggaaggccauaacaccggauaucaaaauugacaaggugaucaauucaaagauucguaacaucuugcaggaacggcucaaugaguucggcggggaagcagcgaaagccuucaguaaccuggaucagaaucccauaugguuuaacaaggacaaaggaaucgcuauuaaguccguaaaaaucagaggcauugccaaugguaccgcaaucagggugaagaaggauauacacgggaacacuauuaucggcaauaacggauauccuaucccaaaugacuacguuaacacaggcaauaaccaucacgucgcuauuuuccgcgaucgagacgggaaucuacaagagcacaucgugucuuuuuaugaagccaccgcaagagccauacagaaccugcccauuguggaucggaauuacaacagcgagaaagacugggaguuccucuuuuccaugaagcagaacgaauacuucgucuuuccuaauccaaacacuggauucaauccccuugagaucgaccugaggaacgaagagaauuaugcuuugauuucaccgaaccuguuucgcguucagaaauuaagccauuacuauuacguguuccgucaccaucucgagaccaauguggauacaaaccugcaacuuaaggacaucacguggaaaagaauaaaggcgauuaauaaccugaccggcguagucaaagugcggaucgaucacuuggguaggaucguugacgugggggaauauaaguga

SEQ ID NO: 3248 - RNA, 4176 nt, Artificial Sequence
  Cas9 variant
augaagaaaagaaucgacgauuacauucugggccucgacauagggaccaacagcugcggaugggccgugacagauaagaaaaauaaccuucugaaguugagggguaaaacugcuaucggcucccacuuauucgaggaagggcauacggcagccgaccggcgcggauuucgaaccacacguagaaggcugaagcggcgcaaguggagacuaaggcuccuggaggaaauuuucgcggagcccauggcugaagucgauccuggcuuuuucguucggcuucaccagucuugggugucaccacuggacaaaagucgcaagaaauaucaagccaucguauuuccgacugcaaaggaggaucaggaguacuaucagaaauaccccaccauuuaucauuugcgagacgcccucaugacacaggauagacaauucgaccugagggaaaucuuucuggcuauacaccauaucgugaaguaccgggguaauuuccuccaggauaccgcagucaaggacuuugaggccagcaaaauugaaguggggccuaucuuaacuaacauuaauaacgcuuucgccgauaagaucguugagggacaggaccugauagagcuuaauguggcgaacgcagccgaaauugaggcugucauccguggcaaagacgccgauaagacauuguauaaaauggacaaggugaaaaagauugcaaagcugcuaaccgauuccacggcuaaagaacagaagaauguagccaaacaaaucgcgaacgccaucaugggcuacaagacucagcucgagaccauucuggggaaagaaauagacaagaaugauaaggcacagugggaguuuaaacuuucugacgcugaugacaagcuggaugccuugcucccagaccuggaugagucggaccagacaguuguggcugaaaucgagaaauuauucucagccauuacucugagcaccaucgucgacgaaaacaagagucucucccaaucuaugguggagaaauacaauaagcaccaccaggauuauaaacuucugaaagcauacauagagagcuugcccgaccgcgcccaggcuaagaaacuacugcucgcguaugaucuguacgugaacaauagacauggacaccuucuggaagcaaagacagaguuuaaacaagacuccaccuugacgaaggaagauuucuauaagacugucaaagacaaccucgaugacucagagcuggcccauaagauugcucaggaaaucgccgcagauaacuucaugccuaaacagaggacaaauaguaacgguguuaucccauuucaguuacaccaaauugagcuggacaagaucauugccaaucagagcaaauacuaucccuuccuagcugccgaaaacccuguggaggaucaccggaagcaggcaccauacaaacucgacgagcugguacgauuucgcgugccguacuaugucggccccaugauaaccgcggaugaacaggagaagacuucugggaaguccuucgcuuggauggugagaaaagaacaaggacagaucacaccuuggaauuuugagcagaagguugacaggcaggagucagccaacaaauucauuaagcggaugaccaucaaagacacguaccuuuugggcgaagaugugcugccagcaaauagccuccuguaucaacgcuuugagguccuuaacgaacugaauaacaucagagugaaugguaguaggauuucuguagacuugaagcagcagauauucaacgaucucuuugaggaaaagaaaaccguuacagagaaggcccugaucuccuacuuaaaacagaaucugcaucuacccacuguggagauuaaggggcucgcugacccuaccaaauucaacagcucgcuggccucuuauuaccaccuuaagaauuugcaugucuuugauaaggaacuggcagacccacaauaucagaaagaguucgaaaagaucauugaguacuccucaaucuuugaagauaaaaagauauuccaggacaaacuccacgcugaguucaaguggcugacacccgcccaauuuaaggcgaucaguacuuggcguuuacagggauggggccggcugagccgaaaacuuuugguggagcuccaugauaccaacggccagaacauuaucgaacagcugugggacucccaaaagaauuucaugcagauugucacagagccggauuuuaaagaagccaucgcuaaggagaaccagaauauaacccaggaaaacgggguggaggagauucuagcagacgccuacacuucuccugcuaauaaaaaggccaucagacaaguugugaaaguagucgcagaugugguuaaggcggccagcggaaaggcucccgcccaguucgcaauugaauuuacgagggacccagacaaaaacccucagcugucacacauccgcgguacaaagcuccugaaggcuuaucaggagaccgccggcgaacuuguggaucaaaauuugacuaacagucugaaggaggcaaugaccucccggaaauuacucaaggacaaguacuuccuguauuuuaugcagacagggagagaugccuacaccggcaaaaagauaaauaucgacgaggucagcacuaacuaucagauugaucacauccuuccccaaucuuucauuaaagacgauucauuugacaauagggugcugacagcuacgccauugaacgcggaaaagagugaugacguacccuacaaacgcuucgccaauaacuaugugagcgaucucaagaugaccguuggagagauguggaagcauuggcagaaagcagguaucauaaauaagcacaaacuggggaaccuacugcucgacccugaccgacuguccaaguuucagaaaucuggcuucauuaaccggcagcuugucgaaacuucgcaaaucgugaaguuggugagcgucauccugcagaauaaguacccagaugcugagauuaucacaguuaaagccggagacaacuccgccuuacgucagagacucgaucuguacaagucaagggacgugaaugauuaucaucacgcuauugacgcauaccuuaguauaguguguggcaacuuucuguaucagguauacccgaaauaucgccccuacuucgucuaugggcaauucaagaaauuuucucaggauccugaccuacagaaggaucucaucaagcacuucaaaggauuuaccuucauguggccacuguugcagaaggacaauagcgaacggaaagcccuggaggagauuaaggaaaacaauuccgauagaaucguguuuuacaaacaucccgacauuuucgauaaguuaaggaaagcguacaacuauaaguacaugcucguuucacgagagacaagcacugaaucuuccaguauguuuaauaugaccaucuauccucgcggugagcgggacagaaagaaaacgaggaagcugauaccaaaaggcaacgggcuugaccccaagaucuacggaggcuauagcgguaauaccgaugcuuacauggugauugucaaaaucgaaaaggccaaggagucuauuuauaaagugaucgggauaccgaugcgugcacuggccggcuugaagcaagcuaaaaaccagggaaauuacaaggaggaacuccacaaaguuguggagccucagauuaugcuggacaagaacggcaagccaaaacgcgggguagaaggauuccgggucgugaaggaucaugugcccuuuaaacaggucguucuagacggugauaagaaauucaugcuguacuccgcaaaguaugagacaaaugccaagcaacuuacucucucacaggaaaccaugagaaucgugacagacaaccugaaaaagagugaggaucaggacaaauugcugguaaaggcguacgaugagaucuuacaaaaaguggaccaguaucucccucuguuugaugucaacaaguucaggaauagccuucaccugggccgagcuaaauucuuggaccucgccgugaacgauaagaagauuacucugucgaauauacuaaacgggcugcaugacaaucuuguugugcccaaccucaaaaauaucggaauuaagaccccauuuggccugaugcaguccccuucugguaucacguugagcucaaacgcaauuuuaaucuuccagagucccacagggcuguuugaaaaacggguccgcauagccgaccucuga

SEQ ID NO: 3249 - RNA, 4176 nt, Artificial Sequence
  Cas9 variant
auggagaacaagcaguacuauaucggccuggacguggggaccaauagcgucggaugggccguuacagauacuuccuacaaccuccuuagagcuaaagguaaggacauguggggcgcaaggcuguucgaugaagccaaaacggcgguggagcggcgcaccaagcgaacaucucguagaaggucagaacgggagaaagcucgcaaggccauguugaaggaauuauuugcagacgagauuaauaaaguagaucccaacuucuuuauaagacuggaggaaaguaaguucuuucuagacgauaggagcgagaauaaccggcaacgcuauacucucuucaaugacgccaaauuuaccgauaaggacuacuaugaaaaauacaagacaaucuuccaucugcgauccgcucuuauuaacucugaugagaaguuugacgugagacuggucuucuuggcaauccucaaucuguuuucgcacagggggcacuuccugaacgccucacucaaaggagauggcgagauucaggguguggacaucuuuuauaaugacuuauacgaaguuugcgaggaguucgagauagaucugccucagaucagcaacauugacaauuucgaaaagauccuuagucagaaagggaagucccggaccaaaauuuuggaggagcugucugaagaacuaagcaucuccaagaaagaaaagauaaaguacucacuccugaaacuuauuuguggaaugaagaucaaaguggucgauauuuaugcugacgaggauauccaagaagacgauaagaaaaaggaccugggcuuucgugagagugauuacgagaaaagcucuuuggaagugaaagagaucauuggcgacgaucauuucgaacucauagagcgcgccaaggcgguacacgacaucgggcuguuagcaaacauuaucggaaauuccaaauaucugugcgaagccagaguugaggcuuacgacaaccaucacaaggaucuccagaaaauaaaggagcuucugaagaaauaugacauuaaggccuacacugauauguuuaggaaaaugacagacaagaacuauucagcauacguggguagcgucaauaguaacaucgcuaaagaacggcgaucuguggauaaucgcaagaucgaggacuuguacgaauauauuaagaaaaucgcccuaaagaacauuuccgaugacaaugaggauaaaauagagauccugaagaaaauugaaaccggcgaguuccucaagaaacagcugacggcgagcaacggggugaucccaaaucagcuucaaucgagagaacugagggccaucuugaagaaggcagagaacuaccucccguuucugaaagaaaagggagagaaaaauuuaacugucucugagaugauuauacagcuguucgaauuucagauccccuauuacguuggcccucuagacaagaacccaaagaaggauaagaaugcuaacuccugggccgugauucccucaggugggcggauccucccuuggaauuucgaggacaaaguagaugugaagggaagucgcaaagaauuuauugagaagauggucagaaaauguaccuaucugagcgaagaacacacacuuccaaagcaguccuugcuguacgagaaguucauggugcucaacgaaaucaauaacauaaaaaucgacggcgagaagauuucuguugaagcuaaacaaaagaucuauaacgaccuguuuaugaaaggcaagaaggugagccagaaagccauuaagcaggagcuuaucucacugaauauaaugaguaaagauuccgucuugagcgggauugacacugugugcaacgcauaccucucuucaaucgccaaguucaggggaguauuugaugaaaauguuaacaaucaaaguaccauugacaugaucgaggauauaaucuuccugaaaacaguguacagcgacgagaagcguuucgucaaagaagagauuguggaaaaguauggugaugagaucgacaaggauaaaauuaagcggaucuuaggcuuuaaauucuccaacugggggaauauaucuaagucguuucuggagcuagaaggagcugacgucggcaccggugagauucgaagcaucauccagucccucugggaaacgaacuucaaucugauggagcuuuugucaaguagauuuacuuacauggaugaacuggagaaaagggugaagaagcucgagaaaccccugucugaauggacaauugaggacuuagaugacauguaucugagcuccccuguuaagcgcaugaucuggcagucaaugaaaauuguggacgaaauacagaccguaaucggguacgcgccaaagcggauuuucgucgagaugacuagaagcgaaggcgagaaagugaggacaaagucucgcaaggaucgacuuaaagaguuguauuccgcaaucaaggaagacaguaaacaauggguuaaggagcucgaugccaaagacgaaagcuacuuucggucuaagaagauguaucuguacuaccuacagaaaggacguuguauguauuccggcgaggugauugaacuggauaagcucauggacgauaaccuguacgacaucgaucauauauauccgagaucauucgucaaagacgauagucuugacaauuuggugcugguaaagaaagagaucaacaauaggaagcagaacgaccccauuaccccucagauccaagcuagcugccagggguuuuggaagguguuacacgagcagggauucauuucgaaugaaaaauacucccgccucacgcggaagacccaggaguuuucugaugaagagaaacugagcuucaucaacagacaaauaguugagacaggucaggccacuaaguguauggcacagauucuucagaaaucaaugggcgaagacgucgaugugguguuuaguaaggccaggcuggucuccgaguuccgacauaaauucgaauuguuuaagucucgccucaucaacgacuuccaccacgcuaaugaugccuaucugaacaucguuguggggaauagcuacuuugugaaguucacccggaacccagcaaauuuuauuaaagacgcgagaaagaaccccgauaauccugcuuauaaauaccauauggacagguucuuugagcgugauguaaaguccaaaucagaagucgccuggauaggacaaagcgagggcaacgcagguacaaucgccauugugaagaagacuaugaguaaaaauucuccacuaaucaccaagaaaguugaggaagggcacggcuccauuacaaaggagaccaucgugggagucaaagaaauaaaguucggccgcaacaagguggagaaagcugacaagacucccaaaaaggccaaucugcaggcauaccggccgaucaaaacgagcgaugaaagacucugcaacauucugagguaugggggacgaacaucgaucucaauuucugguuacugucuuguugaguaugugaagaagcggaaaaccauccgcaguuuggaggcuauaccuguauaccugggcagaaaggacuccuuaagcgaagagaaacuccugaauuauuuuagguacaaccuuaaugaugggggaaaggacucugucagcgacauucggcugugccuacccuucaucuccacuaacucacucgugaaaaucgauggcuaucuguacuacuugggugggaagaacgacgaucgaauccagcuguauaaugccuaccaauuaaaaaugaagaaggaagagguggaauauauuagaaaaauagagaaggcggucaguaugagcaaauuugacgagauugaucgcgaaaagaacccaguucucaccgaggagaaaaauaucgagcuguacaacaagauucaggacaaguucgagaauacaguguucucuaaaaggaugucccuuguaaaguauaacaaaaaggaucugucauuuggcgacuucuugaaaaauaagaagaguaaauuugaagagaucgaucucgaaaagcaguguaaagugcuguacaacauaauuuucaaucuaagcaaccugaaggaggucgaccuuuccgauaucggaggcucuaaaucgaccgggaagugccguugcaagaaaaauaucacuaacuauaaggaauuuaaacucauucagcaaagcaucacaggacuguacucaugugagaaggacuugaugacgauuuga

SEQ ID NO: 3250 - RNA, 4176 nt, Artificial Sequence
  Cas9 variant
augaagagaaacaaugacuacuauaucggccuggauauggggaccaacagcgugggaugggccacaacuaauccccaggguaggcuccuucgguucaacaaaaaggacauguggggcucccgccuguuugaggaagcuaaaacggcagccaagacccgaacauuccguacuucuagaaggcgguacgaucgcgucagacaaaggauugaguuuuugcaggacauauucgcgccuaucauugcuaaaaaggauuuugaguucuuuaugcgguuaaaggagucaaaauuccaccuggaagacaagaaaaccgaugggaaguuugcccuauucaaugacgcagauuuuacagacguugaguauuucgaucgcuacccaaccaucuaucaucuccgagccgcucugauuaaaccgaaccacaucacugaccccagacuucuguacuuggcaauacaucacaucauuaagaauaggggacauuuucucuucgccggcacagauauggagaguauccggagcuuccagauuguguauacccagcuguccgaacaccugaagucuaucaaccucgacuuugaguuaccuguagacgcucaagauaaauucgccgcgauacugcuuaaugaaaaguugaacaaacgugacaagaaaaagcagcugaaagagcuaugcccacacaaggauaagcgccucgaguacgcauuuaaugccauuaucggugggaaaacgaagcugaaagacauuuucggaguggaagaguacgaugaaggcacuaagaaagcugucgacuuugagaaggccgauuaugacgaagauaaggacgagaucgagucggugaucaaagaaaacauucauguucuuaaugcacugaaggcuguguacgauuggaccauauugacaaacauccucggcgacuaugccuacauuucagagagccaggucgcgcuguaugaagcccacaaaaaggacuuaagaauccugaaaagucucauaaagaaguacgcaaaaucccaguaugcugaugccuucaggcaugagaaugugaaggggaacuacgcuaacuacguaggaucuacuaauuaugacaacaaacaacccguuauugauaauccuagcgugacccaggaagacaucaacaaguacuuugccgauauccuucuguccauuacaccagacgagucagaucgggagaguuaucaguacaucaccgaacgauugcacaaaggugaggcacuacccaagcugcgcacgaaggccaauagcguccucccucaccagauucauaaaauagaacuggagaagauccuugcuaacgcggccaaaaauuucccauuucugcaagaaaaggacucuuccggcuauacugcagcucagaaaauugugaagaucaugauguucagaaucgaguacuauguggggccguugaacacauaccaccaugucgaucagggaggccacgccuggaugguuaggaaagcagaggguaagauuacccccuggaauuuugacgaaaagguggauaaagaggccucagcugaaaaguucauacggaacaugacuaauaaauguacauaccucaucgggaaggacguaauuccuaaacaaagccuguuauauagucgcuacaaggugcugaacgagcuaaauaaccucaaggucaauggagccccaaucucuguggcacugaaacagaagauuuaugaggaacuuuuuaaaaagcagguuaacgugaccuucaaccaguugaaaacguuccugaagacccaaggcgaggaugcggacgaaaucauacucuccggcgucgacgaggcugcccauaaguuuacaaauaaccugcagacuuaccacaaauucagagcaauccuuagggauaagauugaauuugagccccagcguagcaugguggaggacaucauucgguggaaaugccugaugggggaugacaucaccauguggaagcacaaaauagaaaaggaguauggagaucaguugucggaagaacaacucaagaaaauuacacgacugaauuucaacgguuggucuagauuaucccaggaauuucugacugacguaccuggcguugauaucgagucaggggagguguacaguggaauuauggacgcccuauggaggaccaaugaaaacaucaugcagcuccugagcucccgcuucacauuugcugccgaggucaagaaacagaaucaaggcaccggucggauagaaaagaucacuuaugaugaggugaugaaagacacguaccuuucuccagcagucaagagaagcguguggcaggcuauuacauugguugaagagaucaggaaaauucgcaaggccgaucccaagcgaaucuucguggagaugacccggcagccggacgcgaaaaaggaacguaaacugucaagaaggacucagcuccugaacgccuaccgcgcuauagggaaugauauugcagaguaugaaaaggagcauguaaguaccuuaaucacacaacuggaguccaaaaaggacgaagaccuucggagaaagaaauuguaccucuauuuuacccagaugggaagguguauguacacuggcgagcgaaucgaucugagcucucuacugcgcgacacaaacucaaauauuuaugauaucgaccacauuuacccucggagucucacgaaggaugacagccuggauaacaccguccuuugcaaaaaggaaauaaauuugaaaaagggcaacaaguauauccauagaguguucacugacaaagagcugaagaaacaguacggguacuggaaggccuuaaaagaaaagaagcucauuuccgagaggaaauuuucucgucugaugcgcacaaccgaucuuacagcugacgagcuggccggauucaucucgcggcaauugguugaaacuagccagauggugaaggcaaccgcggauauucucgagaaaaucuaucccaaugucacgauaguguacguaaaggccagaaccguguccgacuuuaggcacgacuaugaacugccaaaaguucgagcucuaaacgauugucaccaugcccacgacgcauaccugaacaucgucguggguaauguguauuacgagaaguucacaaagucaccuuuccgguuuauugcuaaccagaaaggcaagggggauaucaaauauaaucucuaccgccuguucgacaaggaugucaaaguuggagacagaauuaucuggaacgccaaggaagaucuugcaagggugaaagccacuuuggagcgggacaccgugaauguaguccgaaugcccguggagcagagaggccaauuuuucgaugcuacaauacagaagaaggguacuaccaaaaacaugcugguuuuaccacucaaggggagugacgaacgccugcaggauacgucuaaauacggcuauuacgugaggcccagcggaauguccuuuauggucgugcagcaugagguuaagggcaaaucacgugugacaauugaaccugcgcuucugguauauaagaauaagcuaaaaagcgaggacgauuacgccaaguauugcgaagacguccucaaacugcaaaagccaaaaguguuguucaagaacaucaaguuugggucuaaaauccuguucgacggauacccguuuuuacucaagggucggaccgagaauagaauuauaauggcagaugcucagucccuguuccuuggcaaccaggagcugaaaaucuugaagagggugacuaaaauuagugacgauaucgaccacaaggucgaaagccgcauuaagaucacagaugaggaauggaccacucucuggaaaucuguuguggagcagauaguaaccgggaaguuucgaaauagacugggaacacuaaacggcauccugcaaggucggaaaauuaagcuguccaaagacgaggaagccaggcucaaugagcuggauucaaaggaccaggaaacguucuugagucagauccuguuagagcgcuuccuccaauuuagcaccgaagagaaaacucgucugcuucuucaggugauuucguucuccgggaacacaaccggcgucgauuugagacucaucggaggcucuagcgggacaggaacuauaaagaccaauaagaacauuacggaccauucagugauccugaucaacgagagucccacaggccuauuuaccaaucggacuguucugaaccagccuuga

SEQ ID NO: 3251 - RNA, 4176 nt, Artificial Sequence
  Cas9 variant
augaagagaaacaaugacuacuauaucggccuggauauggggaccaacagcgugggaugggccacaacuaauccccaggguaggcuccuucgguucaacaaaaaggacauguggggcucccgccuguuugaggaagcuaaaacggcagccaagacccgaacauuccguacuucuagaaggcgguacgaucgcgucagacaaaggauugaguuuuugcaggacauauucgcgccuaucauugcuaaaaaggauuuugaguucuuuaugcgguuaaaggagucaaaauuccaccuggaagacaagaaaaccgaugggaaguuugcccuauucaaugacgcagauuuuacagacguugaguauuucgaucgcuacccaaccaucuaucaucuccgagccgcucugauuaaaccgaaccacaucacugaccccagacuucuguacuuggcaauacaucacaucauuaagaauaggggacauuuucucuucgccggcacagauauggagaguauccggagcuuccagauuguguauacccagcuguccgaacaccugaagucuaucaaccucgacuuugaguuaccuguagacgcucaagauaaauucgccgcgauacugcuuaaugaaaaguugaacaaacgugacaagaaaaagcagcugaaagagcuaugcccacacaaggauaagcgccucgaguacgcauuuaaugccauuaucggugggaaaacgaagcugaaagacauuuucggaguggaagaguacgaugaaggcacuaagaaagcugucgacuuugagaaggccgauuaugacgaagauaaggacgagaucgagucggugaucaaagaaaacauucauguucuuaaugcacugaaggcuguguacgauuggaccauauugacaaacauccucggcgacuaugccuacauuucagagagccaggucgcgcuguaugaagcccacaaaaaggacuuaagaauccugaaaagucucauaaagaaguacgcaaaaucccaguaugcugaugccuucaggcaugagaaugugaaggggaacuacgcuaacuacguaggaucuacuaauuaugacaacaaacaacccguuauugauaauccuagcgugacccaggaagacaucaacaaguacuuugccgauauccuucuguccauuacaccagacgagucagaucgggagaguuaucaguacaucaccgaacgauugcacaaaggugaggcacuacccaagcugcgcacgaaggccaauagcguccucccucaccagauucauaaaauagaacuggagaagauccuugcuaacgcggcuaaaaauuucccauuucugcaagaaaaggacucuuccggcuauacugccgcucagaaaauugugaagaucaugauguucagaaucgaguacuauguggggccguugaacacauaccaccaugucgaucagggaggccacgccuggaugguuaggaaagcagaggguaagauuacccccuggaauuuugacgaaaagguggauaaagaggccucagcugaaaaguucauacggaacaugacuaauaaauguacauaccucaucgggaaggacguaauuccuaaacaaagccuguuauauagucgcuacaaggugcugaacgagcuaaauaaccucaaggucaauggagugccaaucucuguugcccugaaacagaagauuuaugaggaacuuuuuaaaaagcaagugaacgucaccuucaaccaguugaaaacguuccugaagacccagggcgaggaugcagacgaaaucauacucuccggcguggacgaggcggcucauaaguuuacaaauaaccugcagacuuaccacaaauucagagccauccuuagggauaagauugaauuugagccccagcguagcaugguagaggacaucauucgguggaaaugccugaugggggaugacaucaccauguggaagcacaaaauagaaaaggaguauggagaucaguugucggaagaacaacucaagaaaauuacacgacugaauuucaacgguuggucuagauuaucccaggaauuucugacugacguuccuggcguggauaucgagucaggggaggucuacaguggaauuauggacgcacuauggaggaccaaugaaaacaucaugcagcuccugagcucccgcuucacauuugccgcugaggugaagaaacagaaucaaggcaccggucggauagaaaagaucacuuaugaugaggucaugaaagacacguaccuuucuccagccgugaagagaagcguuuggcaggcaauuacauugguggaagagaucaggaaaauucgcaaggcugaucccaagcgaaucuucguagagaugacccggcagccggacgccaaaaaggaacguaaacugucaagaaggacucagcuccugaacgcguaccgcgccauagggaaugauauugcugaguaugaaaaggagcaugucaguaccuuaaucacacaacuggaguccaaaaaggacgaagaccuucggagaaagaaauuguaccucuauuuuacccagaugggaagguguauguacacuggcgagcgaaucgaucugagcucucuacugcgcgacacaaacucaaauauuuaugauaucgaccacauuuacccucggagucucacgaaggaugacagccuggauaacaccgugcuuugcaaaaaggaaauaaauuugaaaaagggcaacaaguauauccauagaguuuucacugacaaagagcugaagaaacaguacggguacuggaaggcauuaaaagaaaagaagcucauuuccgagaggaaauuuucucgucugaugcgcacaaccgaucuuacagccgacgagcuggcuggauucaucucgcggcaauugguggaaacuagccagauggucaaggccaccgcagauauucucgagaaaaucuaucccaaugugacgauaguauacgugaaggcgagaaccguuuccgacuuuaggcacgacuaugaacugccaaaaguccgagcccuaaacgauugucaccaugcucacgacgccuaccugaacaucgugguggguaaugucuauuacgagaaguucacaaagucaccuuuccgguuuauugcaaaccagaaaggcaagggggauaucaaauauaaucucuaccgccuguucgacaaggauguuaaagugggagacagaauuaucuggaacgcuaaggaagaucuugccagggugaaagcaacuuuggagcgggacaccguaaaugucgugcgaaugcccguugagcagagaggccaauuuuucgaugccacaauacagaagaaggguacuaccaaaaacaugcugguguuaccacucaaggggagugacgaacgccugcaggauacgucuaaauacggcuauuacgucaggcccagcggaauguccuuuauggugguucagcaugaggugaagggcaaaucacguguaacaauugaaccugcacuucuggucuauaagaauaagcuaaaaagcgaggacgauuacgcgaaguauugcgaagacgugcucaaacugcaaaagccaaaaguguuguucaagaacaucaaguuugggucuaaaauccuguucgacggauacccguuuuuacucaagggucggaccgagaauagaauuauaauggccgaugcacagucccuguuccuuggcaaccaggagcugaaaaucuugaagagggucacuaaaauuagugacgauaucgaccacaagguugaaagccgcauuaagaucacagaugaggaauggaccacucucuggaaaucugugguagagcagauagugaccgggaaguuucgaaauagacugggaacacuaaacggcauccugcaaggucggaaaauuaaacuuuccaaggacgaggaagcuaggcucaaugagcuggauucaaaggaccaggaaacguucuugagucagauccuguuagagcgcuuccuccaauuuagcaccgaagagaaaacucgucugcuucugcaggucauuucguucuccgggaacacaaccggcguggauuugagacucaucggaggcucuagcgggacaggaacuauaaagaccaauaagaacauuacggaccauucaguuauccugaucaacgagagucccacaggccuauuuaccaaucggacugugcugaaccagccuuga

SEQ ID NO: 3252 - RNA, 4179 nt, Artificial Sequence
  Cas9 variant
augaaaagcauccugggccucgaccuugggaccacauccauuggaugggcccuggugaaagagucugaaaacgauaaugagaagucagaaauagucaaauuggguguuagauuagugccccugacuacggacgagaggaccgauuucgaaaagggcaaaaguaucacaacuaacgcugaccggaccagcaagcgcuccaugcgacguaaucuacagagauacaagcucaggcgggaggcacugguaucugagcuuaaaaaggaacacuggauugaugagggguaucgcuuuucggaagacggaccuggcucaacauucagcacccugagauugagggccaaagcggcugaggaggaaaucagucuccaagaucuggccaaggugcugcuccagauuaacaaaaagcgggguuacaaguccucucgcaaauuaaauagcgcagaggacgggcaggccaucgauggaauguccgucgcuaaggugcuguaugaccgaggccuuacuccaggcgaauacguuuaucagagaauguuggaugggcaauacgcaauaccggaguuuuauaaaucagaccugcaggccgaauuugauaagaucuggaaccuacagaaaaguuacuaccccgagcucacagcugagcuguaugacaaacuuaccgacaaaaauaagagccagacgugggccauuugcagggaugaacugggagugcaagguuuuaagucuuccuucacuggcaaagagcgguugaaggaagcguacuuuaaccgucagcaggcaucaaaacagaaggucgaccucgaggugcugaccuguguauuacaagauaucaaugggcagaaagccagccugaguggacuccuuucugcuauuuccgaccgcagcaaggaacuguauuucaacagaaugacaguuggccagauguuggugaggcaaauccaggaggauccuaaucggucgcuacgaaacacugucuuuuaccgccaggacuauauagaugaguucgaaaagauuuggucugugcaguccagauuucauccagagcugacccaagaaaggaaaaagaaacucaaggacaucauuaucuucuaccagcggccccugaaaucacagaagggucuuaucagucugugcgaguuugaaagccgcgagguggauauuuccgucgacgggguuauaaagaaaaagaaaaucggaccuagaguguguccaaggucuagccccuuguuccaggaguucaagguauaucaaacagugaauaacauucucgucaauggcgaaccucuggaugacaacgaccgugagaaauuagugggcgaacuggccuuucgggagaagaugaaggggcaggauguucuaaaacuccuguacaagaccucaaaaggaaugcgaaucaacuucgaggaaguggaggguaauagaacgauggcaacuauacuuaaggcuugcgaaaagauugucgagggcuugggguacgacacaagggaucugaguaagaucaccgccuccgaaaaagugagccgcaucgaggagauuuuugcgaaggaaggauucaagucugacuuucuccacuucgauucaagucugccaagcccggaguuugaaucccaggccucuuauucgcuuuggcaucuguuguacagcuaugagaacgacaaauccguaucaggcaaugaaagucucguugagaagaucaaaaagcuguguucuauggaugaggcaagcgcuaaaauuuuauccgguugcacuuuccugucagacuacgggagccuaucugcccgggcuaugagaaagauacuccccuauaugaaggauggccuggaauacuccgccgcaugugccauggcuggauauaggcacaguaaacgcagccuuacaaaggaggaauuggacucucgaguguacgucgaucggcuggagcuccugccuaaaaacuccuuacguaauccaguggucgaaaagauccugaaccagaugauuaaugugguuaacucagugguagacaccuacggcaaacccgaugagaucagaaucgagauggcgagggaacuuaagaagagugcaagcgagcgcgaaaaagcccaaaaggacauugcugccgcaucgaaagucaaugaguccauaguggccacguugaaggggucuccuuucuucaucgacagcccaucacggaacgauauuaucagauauaggcucugggaggaacugaaacccaauggauacaagacccuauauagugguacauacauuccgaaggagcgacuguuuuccaaagacuucgauaucgaacauauaaucccucaggcucuccuguuugacgauucuuucgccaacaagacuauugagagccgccagugcaauaucgaaaaauccaaccggaccgcaauggacuauguuaagucaaaauacgauagcuucggcgugcaggcguauauugacagagucaaggggcuuacaggagugaguaaaacuaagaucaccagguugcugauggagucuaaggauauacccgaggacuuuauuaaucgugaauuacgcgauucccaauacaucgcucggaaagccagagagauucucgaaagcaugguaaaguucgugguuccaacaaccggcucggucacugcaaggcugcgagaggacuggcagcuugugaacgugaugcgggaacugaacugggauaaauacgagaaguugggucucacgucauuucgcgaggacagagacgggagggaaaucccugucauagaggauuggacaaaacggaaugaccaccgacaccaugccauggaugcucugaccaucgccuucacuagacgccaguuuauucaauaucuaaaccaccugaaugcaaagaucgacaccguugauaagacagacauugaucucagggacuacaaccuggaagauaucucuuucgacggccuucgugauggagacaaauuuggcauagugaaggcuuugcagaaaaaguaucuguacaaagacgauaagcagaaguaucgguucgugcccccaaugcccuuagacgaguuuagaauugaagccaaaaggcagaucgaggauguacucgucaguuucaaggcgaaaaauaagguguguaccaaaaacguuaauacuacaaaggugcgcgggggacaacagcgaaagauccagcugacgccuagagguccacuucaugaggacaccauuuacggcaaacggcugcaguaugucacuaaggaagagaaaguugggggauccuuugaugaagccaagaucgcuagcgugugcaaaaagucuuacagggaggcacuaaugcgccgucucauggaguguggcggugacccgaagaaagccuucacagggaagaacagccuggaaaagaaucccguguggguagaugaguuucacuccggcgaagucccuuugagagugcggaccgugucaauggcuagugucuacacaguucgcaagagcgugggacaaucucugaacauugagaaaguauuagacaagcacauaaaagaaauccucagggcccgacuggaggaguauggcgggaaugcauccaaggcguucucaaaccuugaugaaaauccaauuuggcugaacaaggagaaaggaaucgccgugaagagagucacuauugacaguggcaaaaaucccaucccuuugcggagcaagcucgauaaagacggucagauaaucuacggggaaggacagaacccacaggaguccgauuucgugguucccggcgguaaccaucacgcugccauuuauaggaccccgucuggcaagcugcaagacguggucgugucguuuuacgaagcaguuagccgcaagaaucuagggcuggaggugaucgacagaaacuucaaaaaggaugagggaugggaauuucuuuucacgcucaaacagaaugaguauuuugucuucccuaacccagcuaccggcuuuucacccgaagacuacgaucugacagacccugccaauaacgcaauuaucucccccaauuuguauaggguacagacugugaguguuggggauuaccgguuccgucaucaccuggagaccacaguggaagacaacgagaaguuacgcgauauagccuggaaacgaauuggaccaucuggccucgucggugcugugaagguaagaaucgacaaucuggggaggauccuugcggugggagaguacgauuga

SEQ ID NO: 3253 - RNA, 4179 nt, Artificial Sequence
  Cas9 variant
auggagaacaagaauuacagcaucggccuggacauugggaccaacuccgugggaugggccgucauaacagaugacuauaaaguucccucuaagaaaaugaagguguucgguaauacugauaaacacuuuaucaagaagaaccucauuggcgcccuucuguucgacgaaggggcaacggccgaggauagaagguugaaacggaccgcgcgccgacguuacacaagaaggaagaaucgguuacgcuaucugcaggaaaucuuuucagaggaaauuaguaaacuagacagcuccuucuuucauagacucgaugacucuuuccugguaccuaaggauaaaaggggaucgaaguacccaaucuuugcuacucuugaggaggaaaaggaguaucacaaaaaguucccgaccauauaccaucugcggaaacacuuggccgacucaaaggaaaagacagaucuccgccugaucuaucuggcacucgcccauaugauuaaguaccgaggccacuuuuuauacgaggagagcuucgacaucaaaaacaaugauauucaaaagaucuuuaacgaguucauaaguauuuaugacaauaccuuugaagguuccucucugagcgggcagaacgcucagguggaagcaaucuucacugacaagauuuccaaaucagccaagagagagaggguccuuaaauuguucagugaugaaaagagcacaucucuguuuuccgaguuccuaaaacucaucgugggaaaucaggcugacuuuaagaagcacuucgaucuggaggaaaaagcuccccuucaauuuucaaaggacaccuacgaugaggaccuggaaaacuugcucggccagaucggcgauggguucacggaccuguuuuuaguugcgaaaaagcuguaugaugcaauucuccuuagcggaauacugacugugaccgacccuaguacaaaagccccauugucugcuuccaugaucgagcgguacgaaagccaucagaaggaucuagccgcacugaagcaguucauuaaaaauaaccuccccaagcguuauaaugaggucuuuucggaccaaucuaaagacgguuacgcuggcuauaucgaugggaagacuacccaggaggccuucuacaaauacauaaagaaccugcuuuccaaguuugaaggagcggacuauuuccuggauaaaauugagcgcgaagacuuuuugagaaagcagaggacauucgauaacggcucaaucccucaccagauccaucuccaagagaugaaugccauucugcggcgacagggugaacacuacccauucuuaaaagagaaccgcgagaagaucgagaaaauucugaccuuuagaauacccuauuacguggggccucuagcaaggggaaaucgggacuucgcuuggcucacgcgcaacagugaucaggccaucagaccauggaauuuugaagaaauuguagacaaggcuagcuccgccgaggaguucaucaacaaaaugacuaauuaugaucuguaccuuccggaagagaagguuuugcccaagcacucucugcucuaugaaacauuugcaguguacaacgagcugaccaaagucaaguucaucgccgaaggccuuagggacuaccaauuucuggauagcggccagaaaaagcagauugugaaucaguuguucaaagagaagcguaaggugacugagaaagacauaauccauuaucuccacaacgucgauggguacgacggaauugaacugaaggguaucgagaaacaauuuaaugcuucauuaaguacauaucaugaccugcuaaagauuaucaaagauaaggaguucauggacgauccuaagaacgaagaaauacucgagaauaucguucacacccugacgauuuuugaggaccgggaaaugaucaaacagcgacuugcgcaguacgauuccauuuucgacgagaaggugaucaaagcauugaccagaaggcauuauacaggcugggggaagcugagcgccaaacucauaaacggaauuugcgauaagcagacuggcgacaccauccuggauuacuuaauugacgaugguaagaucaaucgcaacuuuaugcaacugauaaacgacgaugggcuuucuuucaaagaaaucauucagaaggcucagguagugggcaaaacagacgacgucaaacaggugguucaagaguugccaggaucacccgccaucaaaaagggcauucuccagaguaucaaaauaguggaugaacuggucaaggugaugggguaugcaccugagagcauuguaaucgagauggcccgggaaaaucagacuaccgcuagaggaaagaaaaacucccagcaaagguacaagcgcaucgaggacucucugaaaaaucuagccccaggucucgauucgaacauucugaaggaaaaucccacagacaacauccagcuucagaaugaucgauuguuccuguacuauuuacaaaacggcaaagacauguacaccgggaagccgcucgauauugaccagcugagcuccuaugauauagaccacaucauuccucaggcauuuaucaaggaugacucaauugacaaucggguucuuacgaguucuaaagauaaccguggaaagagcgacaaugugcccucccuggaggucgugcagaaaagaaaggcguucuggcaacaguugcucgauucaaaacugaucagcgagaggaaguuuaacaaucuaacuaaggcugaacgcggcggucuggacgagcgggauaaagucggguucauaagaaggcagcucguggaaacacgacagaucaccaagcacguugcccaaauucuggacgcaucuuuuaacacugaggugaaugagaaaaaccagaagauccgcaccguaaaaauuaucacacuuaaguccaacuuggucaguaauuuccggaaggaauuugagcuguacaaagugagagaaauaaacgauuaucaucacgcccaugacgcuuacuuaaaugccguuguggcaaaggcuauucucaaaaaguauccaaaacuggagccugaguucgucuacggcgauuaccagaaguaugaccuuaagagguacaucagccguuuuaaacccucuaaggaaaucgaaaaagccaccgagaaguauuucuuuuacuccaaccugcuaaauuucuucaaagaggaagugcacuaugcggauggaauuauaguaaagcgcgagaacaucgaauacucaaaagacacuggcgagauugccuggaauaaggaaaaggauuuugcuacaaucaaaaaggugcucaguuauccacagguuaacauugucaaaaagacggagauccaaacccacgggcuggaccggggaaaacccaaggguuuguucaauagcaacccuucgccaaagccguccgaggacucuaaagaaaaucuggugcccauaaagcagggcuuagauccuagaaaauacgggggauacgcaggcaucagcaacucauaugccgugcucgucaaggcuauuguugagaaaggugccaagaagcagcagaaaacuauccuggaauuucaagggauuaguauccuugacaagauaaauuucgagaacaauaaagagaacuaccuguugaagaaaagguauauugaaauccucuccacaaucacccugccaaaguacucucuauuugaguuccccgauggcacacgacggcgccuggcaagcauucuuuccacuaacaauaagagaggagaaauccauaaaggcaacgagcucgugcugccugggaaguauaccacguugcuguaccacgcgaaaaauauaaacaagaaauuagaaccagagcaucucgaguauguggaaaagcacaggaaugacuuugccaaacugcuugaguguguacugaacuucaaugauaaguacgucggagcuuugaagaacggcgaacggauucgacaggccuuuaccgacugggagacaguggauaucgaaaaacucugcuucucauuuauuggucccgagaauagcaagaacgcagggcuguucgagcuaaccagucagggaucugcuuccgacuuugaguuccugggcguuaaaaucccgagauaccgcgauuaugccccuagcucgcuucucaaggcaacucugauacaucaaucaauuacagguuuguacgaaacuaggaucgacuuaucuaaacugggcgaagauuga

SEQ ID NO: 3254 - RNA, 4179 nt, Artificial Sequence
  Cas9 variant
augaacaauaacaauuacagcaucggccuggacauugggaccaacuccgugggaugggccgucauaacagaugacuauaagguucccucuaaaaagaugaaagugcucgguaauacugauaagcacuucaucaaaaagaaccuuauuggcgcucuguuguuugacgagggggcaacggccgaagauagaagguucaagcggaccgcgcgccgacguuacacaagaaggaaaaaucgguuacgcuaucugcaggagaucuuuucagaagagaugaguaagguagacagcuccuucuuucauagacuagaugacucuuuccucgugccugaagauaaaaggggaucgaaguacccaauuuuugcuacucuggccgaggagaaagaauaucacaagaaguucccgaccaucuaccaucuucggaaacaccuggcagacucaaaggagaaaacagauuugcgccucauauaucuggcccuggcucauaugaucaaguaccgaggccacuuucucuacgaagagagcuucgacauuaaaaacaaugauauccaaaagauuuuuagugaguucaucuccauauaugacaacaccuuugaagguucuagcuuauccgggcagaaugcacaggucgaggccauuuucacugacaaaaucucaaagagugcuaagagagaaaggauucugaaacuuuucgccuacgaaaagagcacagauuuguuuucugaauuucugaaacuaaucgugggaaaccaggcggacuuuaagaaacacuucgaucucgaggagaaggcaccccugcaauuuuccaaggacaccuaugaugaagaccuugagaaucuguugggccagaucggcgaugacuucgccgaucucuuucugguugcuaaaaaguuauacgacgccauucugcucucagggauacuuacggugacugauagcaguaccaaagcaccucugucugcuuccaugaucgaacgguaugagaaccaucagaaggacuuggccgcgcuaaaacaguucauucaaaauaaccugcaggaaaaguacgacgaggucuuuagcgaucagucgaaggacggauaugcccguuacaucaacgguaaaacaacucaggaggcauucuacaaguauauaaagaaucuccugucuaaguuugaaggcuccgauuacuuccuugacaaaauugagcgcgaagauuuucugagaaagcaaaggaccuucgacaacgggucaaucccacaccagauccauuugcaggagaugaaugcuauuauccggcgacaaggagaacacuaucccuuccucaaggaguacaaagagaagauugaaacaauacugaccuuucgcaucccuuauuacgugggcccauuagccagagguaacaggaauuucgcuuggcugacgcggaacagugaucaggccauucgccccuggaauuuugaggaaaucguagaccaggcaagcuccgccgaggaguucaucaacaaaaugacuaauuaugaucuauaccucccugaagagaagguucugccaaaacacucucuuuuguacgaaacauuugcuguguauaacgagcugaccaaggucaaauucauuagcgaagggcucagagacuaccaguuucuggauucaggacaaaagaagcagauagugaaucagcuuuucaaagagaagaggaaagugacugagaaggacaucauucaguaucugcauaacgucgauggcuacgacggcaucgaauugaaagggauugagaagcaauuuaaugcgagucucuccacauaucacgaccuguuaaagaucauaaaagauaaggaguucauggacgauccgaaaaacgaggaaauccuggagaauauuguucauacccuaacgaucuuugaggaccgugaaaugauuaagcagcggcucgcacaguacgccagcaucuucgauaaaaaggugauaaaggcucugacccgaagacacuauacaggaugggguaaacuuucugccaaguugauuaacggcaucugcgacaaaaagacugggaaaaccauucuggauuaccucaucgacgauggauacucaaacaggaauuuuaugcagcugauaaacgacgauggcuuaaguuucaaggacaucauucaaaaggcacagguaguggguaaaacaaaugaugucaaacaggugguucaggagcugcccgggagcccugccaucaaaaagggcauucuucaauccaucaaauugguggacgaacucgucaaggugaugggacaugcuccagagucuauaguaauugaaaucgcccgcgagaaccagacuaccgcacggggcaaaaagaacucgcagcaaagauauaagaggaucgaggacgcgcugaaaaaucuagcucccgggcuggauagcaauauucucaaggaacacccuacagacaacauccagcugcagaaugaucgccuuuucuuguacuaucugcagaacggaaaagacauguacaccggugaggccuuagauauuaaucaacucuccucauaugacauagaucacaucguuccacaggcauuuauuaaggacgauagucuggacaaccgagugcuuacuucuagcaaagauaaucggggcaaguccgacaacguccccucacuggaagugguccagaagcguaaagccuucuggcagcaauugcucgacagcaagcugaucucugagcauaaauuuaauaaccuaacgaaggcugagagagggggacuggaugaaagggacaaagugggcuucauucgccggcagcucguugagacaagacagaucaccaagcacguggcccagauacuggaugcaagguuuaacacugaaguaaaugagaaggacaaaaagaaccgaaccgucaaaaucauuacacuuaaguccaauuuggugaguaacuuccgcaaagaauuuaagcuguacaagguucgggagaucaaugauuaucaucacgcucacgacgccuacuuaaacgcgguggucgccaaagcuauucucaagaaauacccgaagcuggagccugguuucguguauggggauuaccaaaaauaugacaucaagagauacauaagcaggucuaaggaucccaaagaaguagagaaggcaaccgaaaaauauuucuucuacuccaaucuucugaacuuuuucaaggaggaagugcauuaugccgacggcacuauuguuaaacgugagaauaucgaguacucaaaggauacaggagaaaucgcuuggaacaaagagaaggacuucgccacgauuaagaaaguccuaagucucccacaggugaauauagugaagaaaaccgaaauccagacucacggccuggaucgcgggaagccucggggauuguuuaacagcaaucccucgccaaaacccuccgaggacagaaaggaaaaccuggucccuauuaagcaagguuuagacccaaggaaauacggcggguaugcaggaaucucuaauagcuacgcgguucucgugaaggccauuaucgagaaaggcgcuaagaaacagcagaagacagugcuggaguuccaggguauaucaauccuugauaagauuaacuuugagaaaaacaaggaaaauuaucuguuggaaaaaggguacaucaagauucucaguaccaucacacugccgaaauauucccuauucgaguuucccgacggcacucgacggcgccuggccucuauacuuagcaccaacaauaagagaggagagauucauaagggcaacgaacucguaaucccugagaaauacacgacccuguuguaucacgcaaagaauaucaacaaaacacuggaaccagagcauuuagaauacgucgagaagcacaggaaugauuucgcuaaacuccuggaguacgugcuuaacuuuaaugacaaguauguuggggcccugaaaaacggagaacggauucgacaagcauucaucgauugggagacuguggacauagaaaaguuguguuuuuccuucauuggccccagaaauucaaagaacgccggucucuuugagcugaccagccaggggagugcuucugauuucgaauuucuaggagucaaaaucccucgcuacagggacuauacaccauccagccugcuuaaugcgacucucauucaccagucgaucaccggccuguacgagacgcguauagauuugucaaaguuaggugaggacuga

SEQ ID NO: 3255 - RNA, 4179 nt, Artificial Sequence
  Cas9 variant
augaagaacuaccacaucggccuggacauugggaccagcuccgugggauucgccgcuagagaugacgagaauaaccucauaagggucaaagguaagaauguuaucggcgcacggcuuuuugccgaagggaaaacagcgcaggagcgccgaauggcucguacuucuagaaggcgguauaaccgcagaaaguggaggcugcgguuguuaaaugauauuuuccaugacgaaaucgugcacaaagauaaggacuuuuucaaccgccugaagcaaucaaguauuagccccaaagaugaccgaaagaaauacuuuggaucccuacucuucccugagcugucugauucggaauuuuaucauaauggcaaccagacgaucuaccaccuuagacauaggcugaugaccucaaaugagaaggccgacauacgggagaucuauuuggcacuccgucacauuguaaaauaccgcgguaacuuccuggaugacacaccagugagcaguuuugaagccuccgaucugaagcucgggucuuucaucccgacuuuaaaugaccuguuugagaccauugacgucaacuauguguucaauagcgaaaacacaaaucagaucgaguccauacuuuugaacaacgaucugagaaauucagacaagaguaaacagcuaguugaucuccuguacaggaacgugagcgacgucgaugacaagucucuugagaaacaauuuaauaaguuccggaaagauauuuccaaggaaaucgcuaaaucauucgugggaagcaaguuuaacguaaauaagcuguuggcauacgagaccgacgauggcaguaaaauuucucucuccuucagcgacgccucgucugaugacaagaugcuggaauuagcugacaaccuggaugacgagcgaaucaauauccucaacgcccuuaaaguuauuuauucccgcgugagacugaaucagauaauccccaacggcaugggguugucagaaaguaugauugcgagcuacgagcuacacaagaaacagcugaaugaucucaagaagcugcuuaacguccugccuuuucaugagaaauaugcagugaagguggccuacgcugccuauaucggaaauauggacgcacagaaauucacucaagcugaauuguccacaauagagucucucaaggaaaaagauagcauuaagaaggucaucgacugcaaaaccggucacaucacgaacgagucacugauuaguguuaucaaucagauugugguaaacccauacuuagaaaacuccgauuuugagcugauagacaucgugaagaaaauugaucaggacaucaagaauggcgaguaucuacucaaacagaggaacaaucaaaacgggaauaucccccaucagcugcaccagauggaaauggaucaaauuauagagaagcagagcaaguacuacccuuuccuuggagaauugaacccaaaugagaaccggcgccacaucgccaaauauaagauuucugaacuggucgcguuuagagugcccuacuauguuggcccucucaucacuccagaggagcaggccaaaaccucaggugcaaguuucgcuuggaugaagaggaaagaagacggggagauuacaccguggaauuuugaucagaagguggaccgugaagccacugcuagccgguucaucaaacgacugaccgucaaggacacauaccuuuuuaacgaggaugugcugcccgacaauuccuugcucuaucaacaguucaagguacugaacgaguuaaauguugugaaagucaacaauaagagacugucucaggccgaaaaacagggagcauuuaacgaucuauucaaggugaccaaaacggucacugccaagaggcucaagaacuaccuggugucgaauuucaaccaucuugacacaauagagaucaccggcuugagcgauggcgaaaaauuuaauaacgggcugacuuccuauguugacuuccaaaagauuuuuggagauaaaaucaauaaccucgagcugauggacgauuucgaaucauuaauugaguggaguacaguguuugaggaccgccacaucuucgaagagaagguacggaaugaaauaaacuggauuucugagagcgaacugaaacagcuugucgcuaagagauacuccgguuggggcagguugucaagcaagcuccugguggggaucaauaacgaugagggacgcaauauuaucgagcagcuauuugaaaccucugagacguucauggaagcgauaucccgaccugagguuaaaaagcagaucgacgaaauuaacagugauuuuaucaaaaauaccgacauugagagcgugcuggcagacgccuacacaucuccacaaaacaagaaagcuauccgggagacuuauaagauagucaaggauauucagaaagccaugggcgguaaggcacccgaauccaucucaaucgaguucacccguaauccugaagacaaaggggagcucacaagaaguaggcauagcgagauuucgcgcaaguacaaagaacuguccaaggagaucucuaaagaacuuaacgaugaguugaaaagcaagaaaaacucaauggacauugauaaguauuaccuguauuuuaugcagaugggcaaagacuuauacgauggaaagaguauagacaucgaugaccucaauaacuaucagauugaucacaucgugccacaauccuucuacaaagacgacucuuuugauaaucggguacugacuuacuauaccaacaaucagaagaagggcaacaauacaccccuuaacgggcugaauauuagcaacgaaaccagaaaauuguggucccaucuccacgaccugggacuaaucucaaagaggaaauaccugaaucucacuaugcagggucuggauagccuuaguaaguauacgaaacacggcuucauacgacgccaauugguggagacaucucagguuaucaagcuggucgccaacauuuuauccgacgaguucagcgcugauaauaccaagaucauugaagugaaagccaagaugaacucgcagaugcggcauucauuuaaucucuacaaaaucagagagcugaacgacuaucaccaugcacuugaugcguaccugacuaccuucauagggggauaucuauacaauagguacccgaagcuccguggcauguuuguguauggugacuucaaaaaguuugaugucaacgacgcuaacaauguuaagacacugaacuucuugcacgauauuaccaauccuucugacaaauuugugaaccagaucuacgaugaacaaaguggggagcugaucuuagaccgcaagcacgccauugaaacuauaaagaagaucuaucaguacaaauucaugcucauuacacgggagguguccacgaaggacgauaagcugagcgaccagaccguauauucugcaaaaagaaucaauaacgucgccagccccauuccagugaagaaagauuccaauccugagcuuuacggcuuuaggacuggaaacguugaccaucacauggugaucgucaaguaucccaaaaaggauucauucguguacaaaguugugggcauaccaauccgauuuaugcaggaacugcggaguagcaagaaucaaucugaguacgaaaacacauugaaucagauuguacaggcuaagcucaaccgcaaaaaguucgacuucagagucgugguggauaaugucauguaugggcagcugauccaagacggaggucagaaauuuacccuaggcuccucaacauacagguauaacgccaagcagcugguucuugauauggacagucuccggauucugagcgaugagaaauaccgaaauuccuugacugacgaugaaaagaacucugaguucaucaacauauaucaacaggugcugaauguagugaacgagaaguuugacgucuucgacgugagagggacccgcgauaaauuaacgaagggacucgacaaauuucugaauauuaccucgaacgauaaggaaaucguucuucugaaaaucuugagcggccuccauuguaaugcagcuagggugaagauuaacgagaucgguauaaauacaucauucggggaacugcagacuacccacggcauuguccuauccgagaacaguuacaucauuuaucagucucccagcggacuguuugagcguaaggugcggcuuaaagaccucuga

SEQ ID NO: 3256 - RNA, 4179 nt, Artificial Sequence
  Cas9 variant
auggccaacaagaccugguaccugggccucgacaucgggagcgcuuccgugggaugggcagccacagauacugguuauaaaauuauaagaaagaauaaaaagaggcuuuggggcguccggcuguucgaggaagcgaaaacggcugaggaccgccgaggguaccguucuucaagaaggcgguuggcccgcagaaaguggagguuaaaccugcuagaggagcucuuuaccagugaaguuaagaaaguggaugagaauuucuuucugcggcuuaaggagagccaguaucacuacgaagacaaaacacauaagguacccuaugcaaucuucaacgauaaagacuacacugauaaggacuauuacaaggauuacccuaccauuuaucaucugcgcuccaaauugaugacagaggaaaauccagacauccgaaagguguuucucgccauucaccacaucauaaagaacagaggacauuuccugcugcaaggccagucuuuuaaggaugguaaucucaacaauuuaaucaaagagcugcuugaguuggacauucugcacgucggguucgaagugaccgaggaaguuguggauaagaucgcugacauuucgcuagagaaaaagacuucaaaggacaaacucaacgauaucaaggaacuguacccgaaagagaagcagcuucuggaggucuuuagguugauauucggaggcaaaacaagccucgacaagcuguuugcaauugaugaauauaaggaguuagacgccgcuaucaaaaguguguccuucaaggagaaaauuuacgaagaaguacggcacgauuaugagcagguucugucuaauuacaucgagcuccuugaccuggccaaguugguguaugauagcaucauucuauccgacauuaaaaaggaaggcaagacccugucagagaguaaagucgaacucuuugagaagcaucgugaugaccugcuuaaacugaagaacuuggugaaaaaugauagcaagcucucugaagacaagaaaguggagcuguacgcguuaaucuucaaggaggacaaagauaaggggacgaacuacgucaauuauauucgcaaauccgaagagggaaaggguugcaacuacgaagacuucaaaaaguuucugguuaaggagcuagcaaaacucgaggaaucaagcgugaagacugagaucauaaaagaucuggaacuugagcaauucuugccccugcagagaaccaaggacaacaguguagugccuuaucagauucacaaagaggaacucgucaagauccuggauaaugccgcuagguaccauucuuuucuuaacgagaaggacgaauccggcuauaaugugcgggagaaaguuauccagcuguuggaguuccgaauaccauacuauguggggccccucaacagcucgaagaaagccaaggaaggaggcuuugcauggucuguccgcaauacagguuacgaaaacacuccugugaccccauggaauuacuccaaaguaaucgaugagucagcuagugccgagaaguucauuacaaaccugaccaauaaguguacguauuuaaaaggggaagacguucugcccaagagcucccuacucuacucugaguuugcgcugcuuaacgaauugaaugcccugaaauaugauggaaacagaauaagccucgaggcaaggaauacuaucauugaaaagcuguucaaacaacagggcaagaaggugacaaaaaccucaaucaagaacuuacugaaagcugagggcuacaucgacgggaagggagagauuacugguauagauaucacagucaaaaaugaccuuaagaguuaucgggauuuuaaaaagauuuugggcaacaaguucaacuccgaacacguggagaauaucauucucuggaucacccuguacggggaaagccgcaaacuaauaaaggccaaaaucgagucugucuauggagagguguacucaaaggacgaaauuacgaaaaugaguagacugguuuacaaggacuggggcagguuuagccguaagcuccugaccgagcuuguguccaaaaaguuguauaacgaagagacaggugaaugccugaauaucauuggggcuaugcggcagaacaauaucuuauucauggagcuccuggccgaucgauuugacuacucuaaacagauaguagaguucaacaaggaacuucaagaggaugucacugaaauugcaccugagauccuggacgauuuguaugugucgccagccguuaaaagaagcauuuggcagaccgugaggaucgucgaggaacucaagaagauaaucggcugugcuccggcgaaaauuuucguggagacaacucgcuccaaucaggaaaagaaaaagcccaccgacucacggaaaaagcaacuggagcuagcauacaaggccguuaaaaaggaugugaaagaacuggagaaggaaaucggaacaauuaacuuugacguucucaaugauagacugaguucugucgagccuagcaaacuuaaggcuaagaaauuguaucuguacuauacccaguuagggaggugcauguacuccgaggaaccaaucaacauaucagaacucuucgacaauaacaaguacgauauugaccacaucuauccccagagcaaaaucaaggaugacucuuuuacuaauacggugcuggugaaacgcgaauccaacgccgcaaagacagaccgauacccucuuggcagugauauucagaccccaagcaaucggcguuucuggaaauuucugaaggagaagggacuaaucucugacgagaaauauaacagacucgucaggacugaagaguucuccgaugaggaacugucagguuuuauugcccgccaauugguugaaaccagucagagcgugaaggcuguggccucgauacugggcgaguuaaaccccgagacauccaucuguuacucuaaagcagaaaauguaagcucauuccggcagaacuuugggaagauuaaaaagggagacagagauaguaagaauaacgaccagcucaucaaagucagggagauuaaugauuaucaucacgcgaaggacgcuuaccugaacgugguugugggcaaugucuaugauaccaaauucacucgaaacguguuuaauuucaucaaggacaaaaaggauggucgcaaguacucccuuaacaaaguauuuuacgaaaaugugucugacagcaagacaguagccugggagauggacaaaacgauacaucaagucgaaaaggugaugaacaauaacaauaucauggugacccggagaacuuccgagcagaaagggggccuguucgaugcaacagucuauaaggccaagguugcugccaaagcaaaggacggaguguacuauccguugaaaaccucaaacagcguagugaaggaugucgcuaaauacggcggguauacaaguauuggaaucgccuacuauucuauuuucgaguacacuaucgugaacaagaaaggugaagagaagauaaccaggauuaucccuauccccauuuacauaucccagaauaucaaggacagcacggcgcucauugaauuuggcaaaucgcagaucuucugccgugccuaugagaagauuaaagauuuuaagcugcuauaccgcaaacuguguaucgggucaaagauaaacaucaauaacuaucaauacuauauuggaggcaagucugacgaacgguucuacuaugauagugcuauccagguuacccuugacaaaaaguccgagaaauaccucaagauucugagcaaauaccagaauuggaagaaggagaacaaagauggugaauugugggagaauaucacaaaggaaaacaauauagagcuguauaacaaauuaguggagaagaugaacucugaaauuuuuacuaaaaagaaaagcaauaaauacaaugagcucaacuccgaagagaucagaaauaacuucaucaagauuucagucgaggaacaggcaaaagugcugcuugagauccugaauuugcucaccaacaagaaaaguauauuugaccuaaagagcauugauaucaaagccgcuagggggaagauuucuuucaaccugacaucccugauccaauuuucaauaauugaacagaguaucacuggcuucuaugagaaggaaaucaccauuaucggagacaaaggcaaugauauggagaacaauaacagcuga

SEQ ID NO: 3257 - RNA, 4179 nt, Artificial Sequence
  Cas9 variant
augaacaauaacaauuacagcaucggccuggacauugggaccaacuccgugggaugggccgucauaacagaugacuauaagguucccucuaaaaagaugaaagugcucgguaauacugauaagcacuucaucaaaaagaaccuuauuggcgcucuguuguuugacgaggggacgaccgcagaagauagaagguuaaagcggacagcccgccgacguuacacuagaaggaaaaaucggcugcgcuaucuacaggagaucuucucaccugaaauuaguaagguagacagcuccuuuuuccauagacucgaugacucuuuucuggugccagaggauaaaaggggaucgaaguacccgaucuucgcgacccuugcugaagagaaagaguaucacaagaacuuucccacaauauaccaucugcggaagcaauuggccgacucaaaagaaaaggcagaucuccgccugaucuaucuggcccucgcucacaugauuaaauaccgaggccauuucuuauacgaggagagcuuugacaucaagaauaacgauauucagaaaaucuucaaugaauuuauaaguauuuaugacaacaccuucgaggguuccucucugagcgggcagaaugcacaggucgaagccaucuuuacugacaagauuuccaaaucagcuaagagagagagggugcuuaaguuguucccugaugaaaaaucaacaggacuguucagcgaguuucuaaagcucaucguuggcaaccaagccgaguucaaaaagcacuuugaccuggaagagaaagcgccacuucaguucucuaaggauaccuacgacgaugaccuggaaaauuugcucggccagaucggggauggauuugcagagcuguucguggccgcuaagaaauuauaugacgccauucugcucuccgguauacuuacggucacugaucccucaaccaaggcaccucugagcgcuaguaugaucgaacgguacgagaaccaccagaaagacuuggccgcgcuaaagcaauuuauucagaacaaucugcaggaaaaauaugaugagguguucucugaccaguccaaggacggcuacgccggguauaucaacggaaagacaacucaagaggcauuuuacaaauacauaaagaaucuccugagcaaauucgaaggcucggauuauuuucuugacaagauugagcgugaagauuuccugaaaaagcagcgcaccuuugacaacgguucuaucccacaucagauccacuugcaagagaugaaugcuauuaucagaaggcagggggaacauuaccccuuccuccaggagaacaaggagaaaauuaagaaaauacugacauuccggaucccuuauuacguaggaccauuagcccgaggcaauggcgauuuugcuuggcugacccgcaacuccgaccaggccauuagaccguggaauuucgaagagaucguugaucaagcaucaagugccgaagacuuuaucaacaagaugacgaauuaugaucuauaccuccccgaggagaaagugcugccuaagcacagccuuuuguaugaaacuuucgcugucuacaacgagcugacaaaagugaaguuuauugcggaagggcucagggacuaccaguuccuggauuccggacagaagaaacagauagugaaucaacuuuuuaaggagaaacggaaggucaccgaaaaagacaucacucaguaucugcacaacguugaugguuacgacggcauugaguugaaggggaucgagaagcaguucaaugcaucucucagcacauaucaugaccuguuaaaaauuaucaaggauaaagccuuuauggacgaugcugaaaacgaggccacccuggaaaacauaauccacacgcuaaccauuuucgaggaccgcgaaaugaucaagcagagacucgcacaauacgauucacuguuugacgagaaagugauuaaggcccuuaucaggcgucauuauacaggauggggcaaguugagugcuaaacugauaaaugguauuugcgauaagaaaacugggaagaccauccucgacuaccugauugaugacggcuauuccaaccggaauuucaugcaguuaaucaacgaugacggacugagcuuuaaagauauaauccagaaggcccagguagugggccgaacaaaugacgucaagcaaauugugcacgagcuuccagggucucccgcaaucaaaaagggaauuuugcagucaaucaaaauaguugacgaacucgugaagauuaugggucauacuccugagaguaucgucaucgaaauggcgagagagaaccagaccacagcuaggggcaaaaagaauagccaacagcgcuacaaacggauugaagaugcccugaagaaccuagcaccagggcuggacuccaauauccucaaggaguaccccaccgauaacauucagcugcagaaugacagacuuuucuuguauuaccugcaaaacggaaaagauauguauacuggcgagccguuagacauaaaucagcucucuucguacgauaucgaccacauugugccucaggccuucaucaaggaugacagccuggauaacaggguacuuacguccucaaaagacaaucgcgguaagagugacaacguucccucucuggaagugguccagaaacgaaaggcuuuuuggcaacaguugcucgauagcaagcugauuuccgagcggaaauucaacaaucuaacaaaggccgaacgugggggccuggacgagagagauaaagugggauuuaucaggcgccagcucgucgagacccggcagauaacuaagcacguggcacaaauccuggacgcuagauucaacaccgaaguuacagagaaagauaagaagaauaggaacgugaaaauuaucacccuuaagucaaauuugguaagcaacuuucgaaaagaguucaagcuguauaaaguccgcgaaauuaaugacuaccaucacgcccaugaugcguauuuaaacgccgugguugcuaaggcaauccucaagaaauacccaaagcuggaaccugaguuuguguacggcgacuaucagaaauacgaucuuaagcgguauauaucuagauccaaagaccccaaggaugucgagaaggccacugaaaaauacuucuuuuauaguaaucugcuaaacuucuuuaaggaggaagugcacuacgcugacgggacaauuguaaaaagggagaauaucgaauauagcaaggauacgggagagaucgccuggaacaaagagaaggacuucgcaaccauuaaaaaggugcucucucugccacagguuaauauagucaagaaaacugaaauccaaacacacgguuuggaccguggcaagccccgcgggcuguucaacuccaauccuucaccaaaaccgagugaggauagcaaggaaaacuuagugcccauuaaacagggacucgacccucggaaguacggcgguuacgcggggaucucgaacuccuaugccgugcuggucaaggcuauuaucgagaaaggcgccaagaaacagcagaagaccguucuugaauuucaaggaauaucuauccuggauaaaauuaauuucgagaagaacaaggagaauuacuugcucgaaaaaggcuauaucaagauucugagcacaaucacucuaccaaaauacucacuguuugaguuccccgacgggaccagaaggcgacuugcaaguauacucuccacgaacaauaagcggggagaaauucauaaaggcaacgagcuggugaucucugagaaguauaccacauugcuguaccacgcuaagaauaucaacaaaacuuuagaaccugagcaucucgaauauguggagaagcaccgcaaugauuuugccaaacugcuugaaagcguacuggacuucaacgauaaguacgucggugcauugaaaaauggggagagaauuaggcaggccuuuaucgacugggagaccguggauauagaaaagcucuguuucuccuuuauuggaccacggaacaguaaaaaugcuggccuguucgagcuaacaagccaggguagugcgucugacuuugaguuccugggcguuaagaucccccgauacagagauuauacuccguccagccuucucaacgccacccugauucaucagucgaucacgggguuguacgaaacacgcauagacuuaucaaagcugggagaagauuga

SEQ ID NO: 3258 - RNA, 4179 nt, Artificial Sequence
  Cas9 variant
augaacaauaacaauuacagcaucggccuggacauugggaccaacuccgugggaugggccgucauaacagaugacuauaagguucccucuaaaaagaugaaagugcucgguaauacugauaagcacuucaucaaaaagaaccuuauuggcgcucuguuguuugacgagggggcaacggccgaagauagaagguucaagcggaccgcgcgccgacguuacacaagaaggaaaaaucgguuacgcuaucugcaggagaucuuuucagaagagaugaguaagguagacagcuccuucuuucauagacuagaugacucuuuccucgugccugaagauaaaaggggaucgaaguacccaauuuuugcuacucuggccgaggagaaagaauaucacaagaaguucccgaccaucuaccaucuucggaaacaccuggcagacucaaaggagaaaacagauuugcgccucauauaucuggcccuggcucauaugaucaaguaccgaggccacuuucucuacgaagagagcuucgacauuaaaaacaaugauauccaaaagauuuuuagugaguucaucuccauauaugacaacaccuuugaagguucuagcuuauccgggcagaaugcacaggucgaggccauuuucacugacaaaaucucaaagagugcuaagagagaaaggauucugaaacuuuucgccuacgaaaagagcacagauuuguuuucugaauuucugaaacuaaucgugggaaaccaggcggacuuuaagaaacacuucgaucucgaggagaaggcaccccugcaauuuuccaaggacaccuaugaugaagaccuugagaaucuguugggccagaucggcgaugacuucgccgaucucuuucugguugcuaaaaaguuauacgacgccauucugcucucagggauacuuacggugacugauagcaguaccaaagcaccucugucugcuuccaugaucgaacgguaugagaaccaucagaaggacuuggccgcgcuaaaacaguucauucaaaauaaccugcaggaaaaguacgacgaggucuuuagcgaucagucgaaggacggauaugcccguuacaucaacgguaaaacaacucaggaggcauucuacaaguauauaaagaaucuccugucuaaguuugaaggcuccgauuacuuccuugacaaaauugagcgcgaagauuuucugagaaagcaaaggaccuucgacaacgggucaaucccacaccagauccauuugcaggagaugaaugcuauuauccggcgacaaggagaacacuaucccuuccucaaggaguacaaagagaagauugaaacaauacugaccuuucgcaucccuuauuacgugggcccauuagccagagguaacaggaauuucgcuuggcugacgcggaacagugaucaggccauucgccccuggaauuuugaggaaaucguagaccaggcaagcuccgccgaggaguucaucaacaaaaugacuaauuaugaucuauaccucccugaagagaagguucugccaaaacacucucuuuuguacgaaacauuugcuguguauaacgagcugaccaaggucaaauucauuagcgaagggcucagagacuaccaguuucuggauucaggacaaaagaagcagauagugaaucagcuuuucaaagagaagaggaaagugacugagaaggacaucauucaguaucugcauaacgucgauggcuacgacggcaucgaauugaaagggauugagaagcaauuuaaugcgagucucuccacauaucacgaccuguuaaagaucauaaaagauaaggaauuuauggacgauccgaaaaacgaggaaauccuggagaauauuguucauacccuaacgaucuucgaggaccgugaaaugauuaagcagcggcucgcacaguacgccagcaucuucgauaaaaaggugauaaaggcucugacccgaagacacuauacaggaugggguaaacuuucugccaaguugauuaacggcaucugcgacaaaaagacugggaaaaccauucuggauuaccucaucgacgauggauacucaaacaggaauuuuaugcagcugauaaacgacgauggcuuaaguuucaaggacaucauucaaaaggcacagguaguggguaaaacaaaugaugucaaacaggugguucaggagcugcccgggagcccugccaucaaaaagggcauucuucaauccaucaaauugguggacgaacucgucaaggugaugggacaugcuccagagucuauaguaauugaaaucgcccgcgagaaccagacuaccgcacggggcaaaaagaacucgcagcaaagauauaagaggaucgaggacgcgcugaaaaaucuagcucccgggcuggauagcaauauucucaaggaacacccuacagacaacauccagcugcagaaugaucgccuuuucuuguacuaucugcagaacggaaaagacauguacaccggugaggccuuagauauuaaucaacucuccucauaugacauagaucacaucguuccacaggcauuuauuaaggacgauagucuggacaaccgagugcuuacuucuagcaaagauaaucggggcaaguccgacaacguccccucacuggaagugguccagaagcguaaagccuucuggcagcaauugcucgacagcaagcugaucucugagcauaaauuuaauaaccuaacgaaggcugagagagggggacuggaugaaagggacaaagugggcuucauucgccggcagcucguugagacaagacagaucaccaagcacguggcccagauacuggaugcaagguuuaacacugaaguaaaugagaaggacaaaaagaaccgaaccgucaaaaucauuacacuuaaguccaauuuggugaguaacuuccgcaaagaauuuaagcuguacaagguucgggagaucaaugauuaucaucacgcucacgacgccuacuuaaacgcgguggucgccaaagcuauucucaagaaauacccgaagcuggagccugaauuuguguauggugauuaccaaaaauaugacaucaagagauacauaagcaggucuaaggaucccaaagagguagaaaaggcaaccgagaaauauuucuucuacuccaaucuucugaacuucuucaaggaagaggugcauuaugccgacgggacuauuguuaaacgugagaauaucgaauacucaaaggauacaggcgagaucgcuuggaacaaagaaaaggacuucgccacgauuaagaaaguccuaagucucccacaggugaauauagugaagaaaaccgagauccagacucacggacuggaucgcggcaagccucggggguuguuuaacagcaaucccucgccaaaacccuccgaagacagaaaggagaaccuggucccuauuaagcaaggauuagacccaaggaaauacgguggcuaugcagggaucucuaauagcuacgcgguucucgugaaggccauuaucgagaaaggagcuaagaaacagcagaagacagugcuggaguuccagggcauaucaauccuugauaagauuaacuuugagaaaaacaaggaaaauuaucuguuggagaaagguuacaucaagauucucaguaccaucacacugccgaaauauucccuauucgaguuucccgacgggacucgacggcgccuggccucuauacuuagcaccaacaauaagagaggcgaaauucauaagggaaacgagcucguaaucccugaaaaauacacgacccuguuguaucacgcaaagaauaucaacaaaacacuggagccagaacauuuagaguacgucgagaagcacaggaaugauuucgcuaaacuccuggaauacgugcuuaacuuuaaugacaaguauguuggcgcccugaaaaacggggagcggauucgacaagcauucaucgauugggaaacuguggacauagagaaguuguguuuuuccuucauuggacccagaaauucaaagaacgccggccucuuugaacugaccagccaggguagugcuucugauuucgaguuucuaggggucaaaaucccucgcuacagggacuauacaccauccagccugcuuaaugcgacucucauucaccagucgaucaccggacuguacgagacgcguauagauuugucaaaguuaggcgaagacuga

SEQ ID NO: 3259 - RNA, 4182 nt, Artificial Sequence
  Cas9 variant
augaagagagugaccgaagacuacauccugggccucgauauugggacaaacagcugcggaugggccgucacugacaaaaagaauaaccuucugaaauugagggguaagacggcuauaggcucccacuuauucgaagaggggcauaccgcagccgaucggcgcggauuucgaacaacucguagaaggcugaaacggcgcaaguggagacuaaggcuccuggaagagaucuucgcggaacccauggcuaagguugacccuggcuuuuucgugcggcuucaccagucuuggguaucaccacuggauaaaagucgcaagaaauaucaugccauuguguuuccgaccgcaaaggaggacaaagccuucuaccaaaaguaucccacaaucuaccacuugcgagaugcucucaugacccaggacagacaguuugaucugagggagauuuuccuggcaauccaucacauagucaaguuucgggguaauuuccuccaggacacuccugugaaagauuuugaagccagcaagaucgagguugggccaauuuuauccaaaaucaacggagcuuucgccgaaaagauuguggaggaccaagaucccaucgagcugaaugucgcgaacgcagccgaaauagaggcugugauucguggcaaagacgccgacaagacacuuuauaaaauggauaagguaaagaaaaucgcaaaguugcugaccgacucuacggcuaaagaagagaagaauguugccaaacagauugcgaacgccgugaugggcuacaagacucaguuugaaaccauccuagggaaggagaucgauaaaucggacaaggcacagugggaguucaaacucacagauggagacgcugaugacaagcuggaagcccuucugccugauuuggacgagaaugaucaaacuauuauagcugaaaucaaaaagcuauucucagccauuacccugagcacaaucgucgacgagaacaagaguuuaucccagucuaugguggcaaaauauaauaagcaccaucaggacuacaaacugcucaaggccuacauagauacccuucaggaccgcagcauugcuaaaaagcuguugcuagcguaugaucuguacgugaacaauagacacgguaggcuccuggaagcaaagacggaguuuaaacaagacggcacucuuacaaaggaggauuucuauaaaaccgucaaggacaaccuggaugacuccgaauuggcccggaaaaucgcucagaagaucgccgcagauaauuuuaugccaaaacagcgaacuaacucaaacgggguuauucccuuccaacuccaucagaucgagcuggacaagauuauagccaaucagaguaaguacuauccuuucuuagcugccgaaaacccaguggaggaucaccgcaaacaggcaccguacaagcuggacgaacucguaagauucagggugcccuauuacgucggaccuaugaucacaccagaugagcaagagaaaaccagcggcaagucuuuugcguggauggugcggaaagaagacggucagauuacgcccuggaauuucgagcagaagguugaccgccaggaauccgcuaacaaguuuaucaaaagaaugaccaucaaggauacauaccuccugggggaggacgugcuuccugccaauucauugcuguaucaaagguucgagguccucaacgaacugaauaacauucguauaaauggaagccggaucaguauugaucuuaaacagcagaucuuuaacgaccuguucgaggaaaagaaaacugugaccgagaagucuuugacauccuaccucaagcagaaucugcacuuaccaacuguagaaauuaaaggccuggcagaucccaccaaguuuaacagcucgcuagccucuuauuaccaucucaaaucccugcacguuuucgacaaggagcuugcugauccgcaauaucagaaagacuucgagaagaucauagaauacucaaguaucuuugaggauaagaaaauuuaucaggacaaguugcaugccgaauuuaaauggcugacaccugagcaguuuaaggcaaucagcaccuggcgacuccaaggcugggggagacuguccuguagguuacugguggaacuucacgauacuaauggacagaacauuauggagcaguugugggacucucagaaaaauuucaugcaaaucgucacggagcccgauuuuaaggacgcuauagccaaagaaaaccagaacgugacacaggucaaugguguggaggaaauucucgcggacgccuacaccagcccagcuaacaagaaggcaauccgccaaguugugaaaguagucgccgaugugguuaaggcugccggcgggaaaaagccugcacaguucgcgauugaguuuacucgggaccccgauaaaaauccacagcugucacauaucagaggaaccaagcuacugaaggccuaccaggaaacagcuggcgagcucguggaccaaaaacugaccgauagucuuaaggaggccaugacuuccaggaaauugcugaaggacaaauauuucuuauacuuuaugcagacaggucgcgaugcauauacggggaagaagauaaacaucgacgaagucaccacuaauuaccagauugaucacauccucccccagagcuucauuaaagacgauucuuuugacaaccgagugcugacagcuaccccucuuaaugccgagaagucagacgauguaccauauaaacgguucgcaaacaauuacgugagugaccugaagaugacaguuggcgaaauguggaaacacuggcaaaaggccggaaucauaaacaagcauaaauugggcaaucuccugcuagauccggaccgucugaacaaguuucagaaaagcggguucauuaauagacagcucgucgagacuucccaaaucgugaagcuggugucugucauccuucagaacaaauaucccgaugcugagauuaucaccguuaaggcgggagacaauucggccuugaggcagcgccugaacuuauacaagagccgggaugugaacgacuaccaccaugcaauugaugcuuaucucuccauaaucugcgguaauuuccuguaccagguguauccuaaauacagaccauauuuuguauacggcaaguauaaaaaguucucacaagaccccgaucuucagaaagaccugauuaagcacuuuaaaggguucacguuuauguggccucuacuccagaaggauaacagugaaaggaaggccccagaggaaaucaaagagaauaacucugaacgaauugucuucuacaagcaccccgacaucuuugacaaacugcgcaaggccuacaauuauaaauacauguuggugagccgggagaccacaacugaguccucaagcauguucaagaugaccauauuuccgagaggagaaagggaucguaagaaaacacgcaagcugaucccuaaaggcaacgguuuagacccaaagauuuaugggggcuacucuggaaauacugaugcuuauaugguuaucgugaaaauugacaaggcaaaggaguccaucuacaaagucauaggcgugcccaugcgggcccucaccagacugaaccaggcgaagaaacaagggaauuaucaggaggaacuucaucagguucuggaaccucagauuauguuggauaagaacggaaaacccaagaggggugugaagggcuuccgaguaaucaaagaccacgucccauuuaagcaaguggugcucgauggggacaaaaaguucaugcuguacagugcucaguacaaaacgaaugccaagcagcuagcacugagccaggagacaaugcggaucgucaccgauaaccuuaaaaagggagaggaccaagauaagcuccugguuaaagccuaugacgaaauuuugcagaagguggauuguuaccugucuuuauucgacacuuccaauuuucgcaacggccuccaucuggguagaaauaaauucauagaccuugagguaaacgauaagaaaaucacacugucaaacauuuugaaugggcuccacgacaacauggugcugggcaaucuaaagaacaucggaauuggcaccccucuggggcagaugcaagaaaagaguggaaucacucuuagccccgaggcuguccucauauuucagucgccaaccggccuguucgagaaaagggugaagaucgcagauuuguga

SEQ ID NO: 3260 - RNA, 4188 nt, Artificial Sequence
  Cas9 variant
augaagaaagaaaucaaggacuacuuccugggccucgauguggggaccggaagcgucgguugggccguuacagacacugauuauaaacuucugaaggcuaacagaaaagacuuguggggcaugaggugcuuugaaacggcagagaccgccgaagugcggcgcuuacaccgaggggcgcguagaaggauugagcggcgcaagaagagaauaaaacugcuacaggaacucuucucccaagagaucgcuaagauugaugagggauuuuuccagaggaugaaagaaucucccuuuuacgccgaggacaagacaauccugcaggaaaaugcacuuuucaacgauaaagacuuuacugauaagaccuaucauaaggccuacccuacaauuaaucaccugaucaaggcuuggauagagaacaagguaaaaccagacccgcgguugcucuaucuggcaugucauaauaucauuaagaaacgcggccacuuccuguuugagggugauuucgacucagaaaaccaguuugauaccaguauccaagcccucuucgaguacuuacgagaagacauggagguggacauugaugcugacagccagaaggucaaagaaauccugaaggauuccucucuuaaaaauucggagaaacagucaagauugaacaagauacuggggcuaaaacccagcgacaagcagaaaaaggccauuacuaaucucaucaguggaaacaagauuaauuuugcggaucuguaugacaacccugaucuuaaagacgcagagaaaaauuccaucucuuucagcaaagaugacuucgaugcccuguccgacgacuuggcuucaauccucggcgauaguuuugaacuguuacugaaggccaaagcaguguacaacugcagcguucucucuaaggugauuggcgacgagcaauaccuuuccuucgcuaaggucaaaauauaugaaaagcauaaaacagaucugaccaaguugaaagccgugaucaagaagcacuuuccaaauaacuacaaaaagguauucggguauaaccaggacaaugagucaaagaacaauuacagcggauauguugguguguguaagacgaaaaacaagaaacuggucauuaauaacagugugaaucaggaagauuuuuacaaguuccugaagcccauccucucugcgaaauccgagauaaaggaggugaacgacauucuggccgaaaucgagacuggcaauuuucuuccuaaacagaucagcaagucgaacgcagaaauuccauaucaacugaggaaaauggaguuggaaaagauccucucuaaugcugagaagcacuucuccuuucugaaacagaaggaugagaaaggguuaucacauagugaaaagauuauaaugcugcuaaccuucaaaauccccuacuacauuggaccuaucaacgacaaucacaaaaagagcuuuccagaucggugcugggucguuaaaaaggagaaauccccgucuggcaagacaacucccuggaacuucuuugaccauaucgauaaagaaaagaccgccgaggaguucauuacaagccguaccaauuucuguacguaucucauaggugaaucagugcugccuaagaacagucuuuuguacuccgaguauacuguacugaacgaaaucaauaaccuccagauuaucauugacgggaaaaauaucugcgauacaaagcugaaacaaaagauauacgaggaccuuuuuaaaaaguauaaaaagaucacccagaagcagauuagcacuuucaucaaacacgaaggaauuuguaacaagacagacgaggugaucauacugggcauugauaaagagugcaccucuucauugaagaguuacaucgaacucaaaaauauuuuuggcaagcaggucgacgagaucagcacgaagaacaugcuggaagagauaauccgcugggcuaccauuuaugaugaaggggagggaaaaacaaucuuaaagacuaaaauuaaggccgaguacgguaaauacuguuccgacgaacaaaucaagaagauacugaaucuaaaauucucuggcugggggagacucucgaggaaguuucuggagaccgugacaagcgaaaugccaggauucuccgagcccguuaacauuaucacugcaaugcgggaaacccagaauaaccuuauggaguugcugucaagugaguuuaaauucacagaaaauaucaagaaaauuaacucuggcuuugaggaugccgaaaagcaguucagcuaugacggucucgugaagccucuguuuuuauccccaucagucaaaaagaugcuguggcagacccuuaaauuggugaaggagaucagccacauuacucaagcucccccgaaaaagauauucaucgagauggcgaagggggcagaacucgagccugcccgaacgaaaacacgccugaagauucuacaggaucuguacucuuccugcaaaaaugacgcugaugccuuuaguagcgaaauccaguaucucucuggcaagauugagaacgaagacaaucugagacuuagguccgauaaauuguaccuguauuacacccaguuaggaaaguguauguauugcggcaaacccaucgagauagggcauguauucgacacuucaaacuacgauaucgaccacauuuacccacaaaguaagaucaaggacgauagcauuucgaaccggguucucgugugcuccucuuguaauaaaaacaaggaggacaaauauccucuaaagagcgaaauccagucaaaacagcgcggauucuggaauuuucuucagagaaacaauuucauaagucuggagaaguugaacaggcucacccguacaacccccauuuccgaugacgaaacugcaaaguuuaucgcccggcaacuggucgagacacgacaggcuacgaaaguggccgcaaagguccuagaaaagauguucccagagaccaagaucguguacucuaaagcggagacuguuagcauguuuagaaauaaguucgauauuauaaagugcagggaaaucaacgacuuucaucacgcucaugaugccuaucugaauauugugguagguaacgucuacaauacaaaauucaccaacaaucccuggaacuuuaucaaggagaaacgcgacaauccuaagauugcagauacauauaacuacuauaaaguguucgacuacgauguuaagcggaacaauaucacugccugggaaaagggcaaaaccauaaucacggugaaggacaugcucaaaagaaacaccccaauuuacacaaggcaggcugccuguaagaaagggggacuguuugaccaaacuaucaugaagaaaggccuuggucagcacccguugaagaaggaggggcccuucuccaauauuucaaaauauggcggauacaacaaggucagcgcagcuuauuacacccugaucgaauaugaggagaaaggcaauaagauacgcaguuuagaaacaauuccucucuaccuggugaaagauauccagaaggaccaggauguacuuaagucuuaucugacugaccuacucgggaaaaaggaguucaaaauccuggugccaaagauuaaaaucaacuccuugcugaagauaaauggauuucccugccacauuaccgguaagacgaacgauagcuucuuacuccgaccugccguucaauuuuguugcucgaaugacgaaguccuguacuucaaaaagaucauucgguuuucagagauccguucucagagagagaaaauaggcaagacaauuaguccauacgaagaucuuuccuucaggagcuauaucaaagagaaccuguguaagaagaccaaaaaugacgaaaucggggagaaggaauuuuacgauuugcuccagaaaaagaaccuggagauuuaugacaugcuacugacuaaacauaaggauacaaucuacaaaaagcgccccaauucugcgaccauugacauacuugugaagggaaaagagaaguucaaaagccucaucauugaaaaccaguuugaggugauccuggaaaucuugaagcuguucuccgccacucggaaugucucagaguuacaacacauuggcgguaguaaauauagcgggguugcuaagauaggcaacaagaucucuucccucgauaauugcauucugaucuaccagucaauuaccggaaucuuugagaaaagaauagaccuucugaagguguga

SEQ ID NO: 3261 - RNA, 4188 nt, Artificial Sequence
  Cas9 variant
augaagaaagagaucaaggacuacuuccugggccucgauguggggaccggaagcgucgguugggccguuacagacacugauuauaaacuucugaaggcuaacagaaaagacuuguggggcaugaggugcuuugaaacggcagagaccgccgaagugcggcgcuuacaccgaggggcgcguagaaggauugagcggcgcaagaagagaauaaaacugcuacaggaacucuucucccaagagaucgcuaagauugaugagggauuuuuccagaggaugaaagaaucucccuuuuacgccgaggacaagacaauccugcaggaaaauacucuuuucaacgauaaagacuuuaccgauaagacauaucauaaggcauacccuaccauuaaucaccugaucaaagccuggauagagaacaagguaaaaccagacccgcgguugcucuaucuggcuugucauaauaucauuaagaaacgcggccacuuccuguuugagggugauuucgacucagaaaaccaguuugauacuucgauccaagcacucuucgaguacuuacgagaagacauggagguggacauugaugccgacagccagaaggucaaagaaauccugaaggauuccucucuuaagaauagugagaaacagucaagauugaacaagauacuggggcuaaaacccagcgacaagcagaaaaaggcuauuacaaaucucaucaguggaaacaagauuaauuuugccgaucuguaugacaacccugaucuuaaagacgcggagaaaaauuccaucucuuucagcaaagaugacuucgaugcacuguccgacgacuuggccucaauccucggcgauaguuuugaacuguuacugaaggcuaaagccguguacaacugcagcguucucucuaaggugauuggcgacgagcaauaccuuuccuucgcaaaggucaaaauauaugaaaagcauaaaaccgaucugacgaaguugaaaaaugugaucaagaagcacuuuccaaaagacuacaagaaaguauucggguauaacaagaacgagaaaaauaacaauaacuacucaggauauguugguguguguaagacuaaaagcaagaagcuaauuaucaauaacagugucaaucaggaagauuuuuacaaauuccugaagaccauacucucugcuaaauccgagauuaaggaggugaacgacauccugacagaaaucgagacuggcaccuuucuucccaaacagauuagcaagucgaaugccgaaaucccuuaucagcugaggaagauggaguuggaaaagauucucucuaacgcggagaagcacuucuccuuucugaaacaaaaggaugagaaaggguuaucacauagugaaaagauaaucaugcugcuaacauucaagauuccauacuacaucggacccaucaaugacaaccacaaaaagagcuuuccugaucggugcugggugauuaaaaaggagaaauccccaucuggcaagaccacgccguggaauuucuuugaccauauagauaaggacaaaacugccgaagcauucaucacaagccguaccaacuucuguacuuaucucgucggugagucaguucugcccaagaguucccuuuuguacagcgaguauacagugcugaaugaaauuaacaaccuccagaucauuaucgaugggaaaaauauaugcgacaucaagcugaaacagaagauuuacgaggaacuuuuuaaaaaguauaagaaaaucacccaaaagcagauuucuacguucaucaaacacgagggaauauguaacaagaccgacgaaguaauuauccugggcauugauaaagagugcacaucaagucucaagagcuacaucgaguugaagaauauauuuggcaaacagguggacgaaaucuccacuaagaacaugcuggaggaaauuauccgcugggcuaccauuuaugaugagggggaaggaaaaacaaucuuaaagacuaaaauaaaggccgaguacgguaaguacuguucugacgagcagauuaaaaagauccugaaucuaaaauucucgggcugggggagacucagcaggaaguuucuggaaaccgucacauccgagaugccuggauucucagaaccagugaacaucauuaccgcuaugcgggagacucaaaauaaccuuauggaauugcugaguucugaguuuaaauucacggagaauaucaagaagauuaacagcggcuuugaagaugccgagaaacaguucuccuauaauggucucguuaagccccuguuuuuaucaccuagcgugaaaaagaugcuguggcagacacuuaaauuggucaaggaaauaucucacaucacccaggcaccacccaagaaaauuuucaucgagauggccaagggggcugagcucgaaccggcgcgaacuaaaacccgccugaagauucuacaagaccuguacaacaauugcaaaaacgaugcagacgccuuuuccagugagaucaaggaucucagcggcaaaauagaaaaugaggacaaccugagacuuaggucugauaaguuguaucuguacuauacacaguuaggaaaguguauguacugcggcaaaccuaucgaaauugggcauguguucgacaccuccaacuaugauaucgaccacauuuacccccagucaaagaucaaagacgauaguauaagcaaucggguacucguuugcucguccuguaacaagaauaaagaggacaaguacccacugaagucugagauucagagcaaacaacgcggauucuggaacuuucuucagagaaauaacuucaucucacuggaaaaguugaauaggcucacucguacaacgccuaucagugaugacgagaccgcuaaauuuauugcccggcagcugguggaaacucgacaggcaacaaaggucgccgcuaaagugcuagagaagauguuccccgaaaccaagauagucuauuccaaagccgagacagugucuauguuuagaaacaaguucgauaucauuaaaugcagggagaucaaugacuuucaucacgcacaugaugcguaccugaacauuguuguggguaauguauauaacacuaaguucaccaauaacccauggaauuuuaucaaagaaaagcgcgacaaccccaagauagcugauacguacaacuauuacaaagucuucgacuaugaugugaagcggaauaacaucaccgccugggagaaaggcaagacaauuaucacuguuaaagacaugcucaagagaaauaccccuauuuacacaaggcaagcagccuguaaaaagggagggcuguuugaccagacuaucaugaagaaaggccuuggucagcacccauugaagaaagaaggggcuuucagcaacauauccaaguacggcggauauaauaaagugucagccgcauacuauacccugauugaguacgaagagaagggcaacaagauccgcagcuuagagacgaucccgcucuaucuggucaaagauauucaaaaggaccaggaugugcuuaaaaguuaccugacagaccuacucgggaagaaagaaaucaagauacugguacccaagauuaaaaucaauucuuugcugaagauuaacggauucccuugccacaucaccgguaaaacuggcgauuccuuuguguuacgaccagcuguucaguucuguugcagcaaugacgagguccucuauuuuaagaaaauaauucgguucaacgaaauccguucgcagagagagaagauggggaagacaaucucacccuacgaggaucugucuuuuaggaguuacauuaaagaaaaucuuuguaagaaaaccaaggccgacgagaucggagaaaaagaguucuaugaucuguugcaaaagaaaaaccucgaaauuuacgacaugcugcuaacuaagcauaaggauaccauauauaauaaacgcccuaacuccacaacgcugggcaugcuuaccaagggucgguacgaguuuaucaaucucaaaccaaaggaccagauuaucgugaugcuggagaucuugaaacuguucugcacuacaagagaagcgauugauuuagggcucauaaagggcaagcccgccgcuggaguggcaacccugggcaaaaagaucagcaacccggacaauuguauucuuaucuaucagucuauuacagggaucuuugagaaaaggauagaccuguugaaggucuga

SEQ ID NO: 3262 - RNA, 4188 nt, Artificial Sequence
  Cas9 variant
augggggacaccgugaagaacuaccacaucgggcuggauauuggaacaagcuccgucgguuucgccgcuagagacgaugacaauaaccucauaaggguuaaaggcaagaaugugaucgggacucggcuauuuucugagggacagacggcacaagaacgccgaauggcccgugcgucaagaaggcgguauaaccgcagaaaauggaggcugcgguuguuagaugagauuuuccaugacgaaaucauucacaaggaugcugaguuuuucaaucgccugaaacagaguagccuaucccccaaggacgaacgaaagcaguacuuuggcucucuccuguucccugagguaggugauucggaguauuaccaugacgggaaccagaccaucuaucaccuuagacauaggcugaugacacaagaugaaaaagccgacauacgggagaucuacuuggcacuccgucacauuaucaaguaucgcggaaauuuucuggaugacacuccagugagcucauucgaagccagugaccugaaacucgcuuccuuugucccgaccuuaaacgaucuguucgagacaauugacgugaauuacgaguuuucuauggauaacaucaaugaaauagaggacauucuuuugaacaauaagcugagaaacagcgauaaauccaagcagcuacccgaccuccugaccgaaccuaucguuaauauugaugacaagucacuugagaaacaguucaacaaggaaaggacugauaucaguaaagagaucgcaaagagcguggucggcucuaaaaugaacgugaauaagcuguuguccuuugagucaagcggcggguacaaaauugccuucaguuucucugacgcuuccagcgaagauaagaugauggagcucucggacguacuggacgauucucggaugaacauauuaaauauccugaagguuauuuauucccgagugcgccucaaccagaucauaccaucaggaaugggucuuagugaaagcauggucgccgcguacgaccugcacaaacaacaguugaaggaucuuaaaaagcugcucaaugugcugcccuuuaacgagagauaugcagugaaaauugccuacgcugccuauaucggcaauaucgacaagcagaaguucacaaaauccgaagucaagaccauugauaaacuuaaggagaaaucugcaaucaugaacguucuggacuuuaagagcgggcauauuacgaaugaggaauugucaaacgugauaaagguagugaucgucgauaaauaccucaaugacgagaacuucgaauaucacaguauuguggagaagaucaaucaggauaucuccaacggaagcuaccuguuaaaacaaaggaauaaccagaacggcaauauuccucaucagcugcaccaaauggaacuagaccagauaaucgagaaccagucuaaguacuauccauuucucggugagcugaaucccaacucaaaucggaaccacauugcuaaauacaagaucagugaacuuguugccuuccgcgugccuuauuacgucgggccauugauuacuccggaggaacaggagaagaccagcggagcguccuuugccuggaugaaaagaaaggaggauggcgcaaucacacccuggaauuucgaagagaaaguggacaaggaagagacugcuucuagguuuauaaaacgucugaccguaaaggauacauaucuccugaacgaagacguucuuccugacaauucgcuguuguacgagaaauucaaggugcucaacgagcugaaugucgugaaggccaacaauaaacgguuaaccgucgaagagaagcaaggcgcuuuugauaaccuguucaaaaagaugaaaacggugacugccaagaaguugaaaaauuaucucguuagcaaccauaaccacaucaauuccguggaaauuacagggcugucagacguagauaaguuuaacaauagucuuucuaccuacaucgacuucaaaaagauuuucgaugacaaaaucgauaacccagacuugcuggaugacuuugaggauauaauugaauggagcacugucuucgaggaccgaaagaucuuugaggaaaaggugagaaaagauauuuccuggaucucagagagcgaaauaaaggcaguugugucuaaaagguacuccggauggggucgccucaguaagaaacuguuaaauggcaucacaaacaaugaggggcggaacauuaucgacgaacugugggaggagagcgaaaccuucauggaggccgucucuaagcccgaagugaaggagcagauugacggaaucaauuccgauuuuauaaagaacacggacauugagucaguacuugcugaugcguauaccaguccucagaauaagaaagcaaucagagaaacacauaaguuggugaaagacauccagaaggccaugggcggucaagcuccagccagcauuucgaucgaguucacuaggaacccccaggauaaagggcagcucacccgcucccgacacucugaaguuagccggaaguacaaggagauuucaaaagaagucaguaagacacugaaugacgagcuaaaauccaagaaaaacucuauggauguggacaaguauuaccuguauuuuaugcagaugggcauagaucucuacgacggaagcuccaucgauauugacgaccugaauaacuaucaaaucgaucauauuaucccgcagucauucuacaaggacgauagcuuugacaaccgugugcuuacucacuacaguaauaaccagaaaaagggcaauaacaccccuuugaaugggcugaacauagaugacaaaacaagagcaaucuggaaucacuuaagggaucucggacugauuaccaagaaaaaguauaacggucuuacucugaagggcauggaccaguugucuaaauacacgaagcauggguucauccgccggcaacucgucgagacaucccagguuauuaaacugguggccaauauccuaagcgaugaauuuucgaccgacgauacuaagauaauugaggugaaagcuaagaugaacucacagaucagacaaguauucaaucuguauaaggucagggaacucaacgacuaccaccaugccguggaugcauaucugaccacauuuaucggaggcuaccuuuauaaucgauaccccaacuugcgcaauauguucguuuacggugacuucaaaaaguuuucugcggacguggauaaccugaaaaccuucaacuuuuuacacgacauuacuaauccaagugauaaguucgaggaccggauauuugaugaaaaauccggggagcucauccuggacagaaagcacgcuauugagacaaucaagaaaauuuaucaguacaaguauaugcuuaucacgagggaagucagcaccaaaaacggccagcugucugaucagacuguguacagcgccaagcguauaaauaacguuaaagcaccuauccccgugaagaaagacuccaauccagagcuauauggauuccgcacaggcaacguagaucaucacauggucauugugaaguaccccaagaaagacucauaugauuacaagguggucgggaucccucuccgguuuguucaaaaacugaaggaaaccaaagacaauaaggauuacgagaacuugcugaaucagauugugcagaugaaguuaaacaggaaaaagcaggacuucaucguaguggucgacaaugugauguauggacaacucauacaggaugguggcgaaaaauacacacuggggaguagcacuuauaaguacaacgccaaacagcuuguuauuaauauggacaagaccagaauccuggaggauaaccgauaucuaaauucucucgacgagggagaaguguccgagaagcuggucaacaucuacaaugauauuaugaaagugguuaacucacgguuugaccuauucgauaucaacaaguuucgcgaaaaacugaaugacggccuuaacaaguucaaaaauauaaguaacgagcagaaggaggaaacgcuccugaagauuuugagcggucugcauugcggguccgcuaaugugccaaucaaagaguuaggccucaccacaccgcugggaaaacuucaacugcccucuggcauugucuugucggaagaggccguagugaucuaucagagcccuucaggccucuucgaaaacaaaguuagacugaaggaucuauga

SEQ ID NO: 3263 - RNA, 4188 nt, Artificial Sequence
  Cas9 variant
augaagaaagagaucaaggacuacuuccugggccucgauguggggaccggaagcgucgguugggccguuacagacacugauuauaaacuucugaaggcuaacagaaaagacuuguggggcaugaggugcuuugaaacggcagagaccgccgaagugcggcgcuuacaccgaggggcgcguagaaggauugagcggcgcaagaagagaauaaaacugcuacaggaacucuucucccaagagaucgcuaagacagaugagggauuuuuccagaggaugaaagaaucucccuuuuacgccgaggacaagacuauucugcaggaaaauacccuuuucaacgauaaagacuuugcagauaagacauaucauaaggccuacccuaccaucaaucaccugauuaaggcuuggaucgagaacaagguaaaaccagacccgcgguugcucuaucuggcaugucauaauauaaucaagaaacgcggccacuuccuguuugagggugauuucgacucagaaaaccaguuugauacaaguauucaagcccucuucgaguacuuacgagaagacauggagguggacaucgaugcugacagccagaaggucaaagaaauucugaaggauuccucucuuaaaaauucggagaaacagucaagauugaacaagauccuggggcuaaaacccagcgacaagcagaaaaaggccauaacuaaucucauuaguggaaacaagaucaauuuugcggaucuguaugacaacccugaucuuaaagacgcagagaaaaauuccauuucuuucagcaaagaugacuucgaugcccuguccgacgacuuggcuucaauccucggcgauaguuuugaacuguuacugaaggccaaagcaguguacaacugcagcguucucucuaaggugaucggcgacgagcaauaccuuuccuucgcuaaggucaaaauuuaugaaaagcauaaaaccgaucugacgaaguugaaaaaugugauaaagaagcacuuuccaaaagacuacaagaaaguauucggguauaacaagaacgagaaaaauaacaauaacuacucaggauauguugguguguguaagacuaaaagcaagaagcuaaucauuaauaacagugucaaucaggaagauuuuuacaaauuccugaagaccauccucucugccaaauccgagauaaaggaggugaacgacauucugacagaaaucgagacuggcaccuuucuucccaaacagaucagcaagucgaaugcggaaauuccuuaucagcugaggaagauggaguuggagaaaauccucucuaacgccgaaaagcacuucuccuuucugaaacaaaaggaugagaaaggguuaucacauagugaaaagauuauaaugcugcuaacauucaagaucccauacuacauuggacccaucaaugacaaccacaaaaaguuuuucccugaucggugcuggguggucaaaaaggagaaaagcccauccggcaagaccacgccguggaacuuuuucgaccauaucgauaaggaaaagacugcagaggcuuucauuacaucucguaccaauuuuuguacuuaucucguuggugagagcgugcugcccaagucaagucuuuuguacuccgaauauacaguacugaaugagauaaacaaccuccagaucauuaucgacgggaaaaauauuugcgauaucaagcugaaacagaagauauacgaagaccuuuucaaaaaguauaagaaaaucacccaaaagcagauuagcacguuuaucaaacacgagggaauuuguaacaagaccgacgaagugaucauacugggcauugauaaagagugcacaucuucauugaagaguuacaucgagcucaagaauauuuucggcaaacaggucgacgaaaucagcacuaagaacaugcuggaggaaauaauccgcugggccaccauuuaugaugagggggaaggaaaaacaaucuuaaagacuaaaauuaaggcugaguacgguaaguacuguuccgacgagcagaucaaaaagauacugaaucuaaaauuuucuggcugggggagacucucgaggaaguuccuggaaaccgugacaagcgagaugccuggauuuuccgaaccaguuaacauuaucaccgccaugcgggagacucaaaauaaccuuauggaauugcugucaagugaguucacguuuacagagaauaucaaaaagauuaacucuggcuucgaagaugcagagaagcaguuuagcuaugacggucucgugaaaccccuguucuuauccccuucagucaagaaaaugcuguggcagacccuuaaguuggugaaagaaaucagccacauuacucaggccccacccaagaagauauuuaucgagauggcuaaaggggcggagcucgaaccggcacgaaccaagacacgccugaaaauucuacaagaucuguacaauaacugcaagaaugacgccgaugcuuucucuuccgagaucaaagaccucaguggcaagauugaaaacgaggauaaucugagacuuaggagcgacaaauuguaucuguacuauacccaguuaggaaaguguauguacugcggcaagccuaucgaaauagggcauguauucgauacuucuaacuaugacaucgaccacauuuacccccaguccaaaaucaaggaugacucaauuaguaaccggguucucgugugcagcucguguaauaaaaacaaggaggauaaauacccacugaaguccgagauccagucuaagcaacgcggauuuuggaauuuccuucagagaaacaauuuuauaagccuggaaaaauugaacaggcucacacgugccacgccuauuucagacgaugagaccgcaaaguucaucgcccggcagcuggucgaaacucgacaggcuacaaaaguggccgcaaagguccuagagaaaauguuucccgaaaccaagaucguguauaguaaggcggagacaguuuccauguucagaaauaaauuugacauugugaagugcagggagauaaacgauuuccaucacgcucaugacgccuaccugaauaucguagucgguaacguguauaauacuaaauuuaccaacaauccauggaacuucauuaaggaaaaacgcgauaaucccaagaucgcagacacguacaacuauuacaagguuuuugauuaugacgugaaacggaacaauauuaccgccugggagaagggcaaaacaaucauaacugucaaggacaugcucaaaagaaacaccccuaucuacacaaggcaagcugccuguaagaaaggggaacuguucaaucagacuauuaugaagaagggacuuggccagcacccauugaaaaaggaggguccguucucuaacaucagcaaauacgggggcuauaauaagguguccgcagcuuacuauacccugauugaauacgaggagaaaggaaacaagauccgcucauuagaaacgauaccccucuaucugguaaaggauauucaaaaagaccaggaugugcuuaagagcuaccugacagaccuacucggcaaaaaggaguuuaaaauccugguuccuaagaucaagauuaauaguuugcugaaaaucaacggguucccaugccacauaaccggaaagacuaaugauuccuuuuuacuccgacccgccguccaguucuguugcucuaacaaugaagugcuguauuuuaaaaagauuauccgguucagcgagauucguucgcagagagagaaaaucgguaagacaauaucaccuuacgaagaccuuucuuuuaggaguuacauuaaggagaaccuguggaaaaagaccaaaaaugaugaaaucggcgagaaggaguucuaugacuugcuccagaaaaagaaccuggaaaucuacgauaugcuacugacuaaacauaaggacaccauuuauaagaaacgcccaaauuccgcgacaaucgauauucuugugaaggggaaagagaaguuuaaaagccucauaaucgaaaaccaauucgaggucauucuggaaaucuugaagcuguuuucugccacgcggaauguuagcgacuuacagcacaucggaggcuccaaguacucagguguggcuaaaauugggaacaagauaaguagccucgauaacuguauccugauuuaucagucuaucaccggcauuuucgagaaaagaaucgaccuucugaagguguga

SEQ ID NO: 3264 - RNA, 4188 nt, Artificial Sequence
  Cas9 variant
augaacgccaauagagagauggcuuacuauaucggcauugacauggggaccggaagcguggguauggcaauaacagaugaaaacuacaaucugcucaaggucaaaggccaggacuauugguucguuagggaguuugaaacugccaacacgcaaaucaagcggcgcaugcaccgaauuuccaaacguagacuuaggcggcaucaggugcgcguagcgcugaucagaucuuacuucgcugaggaaauuuugaagaaugaucccuuauuuuucaucaggcaggacaacucaauauauuaccuggaggauaaagacagugugcuaaagaccaaggauugccucuuugccgacuauaauuaccacgauaaaaacuacuauaaggacuacccuacaaucuuccaucugcggcaggcauuuauuaaagauacugucaaggacgaugagaaucacacccgcuaugcccgacuucuguacuuggcuaucauuaacauguucgaacauagagggcacuuucuccugaauagcguguccgaggacaucaacaaagaaaugguuaaggacgcaggagagggcuucacacuguaucuccaagagaggauaaaggaaauuaaaccagugucuuacucggauaucuuagacguccugguggagaagaauauuucacggagcgaaaagaaggagcguaucguagaacuuuuugguaucaaaaagaguuguaaaaacgggauggagauuauaaagugcuuguguggacuggaggccaauguugcuaucauguucaaccuagaugacauugaaaacaagcucaccaucguggucuccaaagaugacuaugaggauaagcuggccgaagugcagccgcuuguggacgaggaaucuuuugagcuguugagccgcauaaaacagcucuacgauuacucccagcugcaaucaauuuuaaagggcuauaaagagaaggaagacggcgaggauaaguaccugagugacgucagaguugaacucuaugagaaacacaaggcggaccuuaaacuguugaagaaaguguacaagagggaucuagacaagaaagggaagaucugcgaaggaaagaauauccagcggagcucuaaguauaacuucauguuccgauccgguaaagauggcacuuacucagcauauacaaauagccugaacaguuuuuguucuaagaccauugagaauaaguaccgcagaaacaugaaaaauagggaccgggccucccucuacgauacgaucaagaaagaccugagcgggauugagaacgaugacguaaagaaaauacuucgcgauaucgaaacugagaaguuccugcccaaacagauuaccggagaaaauggcgugaucccuaaccagauccaugcuaaggaguugaaggccauucucaaaaaugcagagaagcaucugccauuuuuaacagaaaaagacgauucgggucugacugucucugagagaauaaucucccuauucagguauugcauucccuacuauaucgggccugugggaaaggacucacguaccggcugggcuaguauuaaagaagagggccaaaucuuuccauggaacauagaacagaagaucgauguugacaagacaagcgaggaguucauuacccggcucaucaaaacguguacuuaccuguccaaugaaaaggugguccccaaacagucucuuguguaugagcgauacugcguauugaacgaaauuaauaacaucaagauaagagggaaaaggauugacccucaacugaagcaggagaucuuuaaggaacucuauauuggaagcaaaugugguaagaaaguuacacgcaagaaccugugccaguaccuugugaauaaaggcgccaucgaggaggauucagaaauaagugggaucgacaaggaucugaacaccuacauguccagcuauggaaagauguaccagauuuucggcgacaaaaucaagcgggaugacauuaaagaggucgcggaagagaucauauauuacgguacuauuuaugggggcgccaaggaaauguuuaaaaagaaaaucgagcaauacgugucugaggauaucuuggacgaagcacagaugaauaggauucucggauucaaguuuaaggauugggcuagacugaguaaaaaguucuuauaucuggagggcuacgacaaagggaaccagaaucagcuaacaacccucaugcaagcccugugggauuacaaccuuaauacgauggaauugaugaacucaccaauguuuaccuucaaggagacacuggagaaacagaagaauaagauggaaaaaguccucugugacuucgaguaugaagaucuggacgaguacuauuuuagcgcuccggugaagcgcaugguuuggcagacuaucgccugcuuaaaagaagugguacagauuaugggacacaaccccaagcgaauauucaucgagaugccucgggcagacgaggaaaaaggugagcaaggccguaaggccuccagaaagaauaggcugcuuucuuuguacgaagagauugaagaugagcgcccauggaaaaaggagaucgaaaacgcugcggagucggggcggcucaauagcaaaagaauguaucuguacuaucuacagaugggaaaggacgcauacaccggcgaagauauugacaucgaggaucuguuugacaacuccaaauacgauauagaccacaucuaucccaggucacucacagaugacaauagucuggaaaacaaccuugucuuggugucugccacuauuaaucaggauguuaagaagaacgacuacccuaucccauaugacaaaauucgagguaauagcaaggugcgcgagcuguggcgguucuuacacgagaaaaaguuuaugaacgaugaaaaauacaauagacucauguccgacgucccccugacccaggagcaacuugcuggguauaucgccaggcagcugguggaaacagcacagggcaccaagggaauagccgauauuaucaagucaguaaucccggacgcugauauuauauacagcaaagccaagaacgugucugacuuccguaaacgcuauggcauguugaagucccggcucacuaaugauuuucaucacgcaaaagacgcguaccugaacguugucguggggaauguguacuucacgaaguuuacacaaaacccuagaaaauauaucaaggaugagaaugacauugagaacaagaaauacaauuauaaccuaaguaagauguacgauaaagacgucaucaggaauggaaagguugcuuggauugcccagaacgguaaaaaggcaggcaccauccagacuauaaagaaagugauggaucgaaacacccccaucauuacacggcaggccuucgaacaacgcggggagcuguaugaccuccagccaaucagcaagcauaaagcuaagaaagaaaauuacgugccuauuaaggccaccaacgagaagaugaaagacguaacuaaguauggaggcuuuacaucucugaaucccgcauacuucgucuuuguggaauacgguuccgcuaaaaagagacagaggugcuucgccguugugcacucauauugggcgaguagcaucaaaaacaaugaggaucuugucacgcauuugaaggaccggggguacgagaacccaauagugauugccgauaagaucaaaaagaacucgcugaucaaauauaauggcuacuucuuauauauuguuggaauggacgcucgaaaacagguggaauuuuccaaugcaaccucuaugugucucaacaauaacuucauccaauacauacagaaaauugagaaggccaauacucugaucgcugaagccaaaaagagacgccccuauauugaugagagcaucacagcagaaaggaacauagcgcuuuacaaugagcugaagaaaaagcaccuagacucaauuuuuaaaaaccacccuaagggcaucgggaguguacucgaguccggagaaggcgccuucguccagcugucuuuggagcagcaaaucgguauucuguacagcaucauucaguuuuccucauucaaaaaggggaccuuuagcuuaacacucauaggaggcccaaaggaagugggucguauccggauuaguggcaauaugccgaaagcuagagagcugaaacuuauccauuauucuaucacugggauguacaaaaaggaaauuaaccuguuggauuga

SEQ ID NO: 3265 - RNA, 4188 nt, Artificial Sequence
  Cas9 variant
auggagacccaggccagcaaccaacugaucuccucucaccucaagggcuaccccauuaaagacuauuucguggggcuugauauaggaacaucaagugucgguugggcuguuacuaauaaggcauacgaacuguugaaauuuagaagccauaagauguggggcuccagguuauucgacgagggggaaucugccguggcgcggcgcggauuucgaucgaugcguagaaggcuggagcggcgcaaacuaagacucaagcugcuugaagaacuguucgcugaugccauggcacagguagacccuacguuuuucaugagguugcgggagucaaaguaucacuacgaagauaaaaccacaggccauagcaguaagcacauccucuuuauugacaaaaacuauacugaucaggacuacuauaaggaguacccaaccaucuaccaucugcgcguggcccugaugaaauccgguacagaugacauucgaaaacucuucuuagcuguccaccacauccugaaguauagagggaauuuucuuuacgaaggagcaaccuucgauucuaacgccagcacuuuggacgaugugcugaaacaggcucuagagaauauaacauuuaacugcuucgacuccucagccgcgaucggcaguauuggccaaauccucauggagcuggggaagaccaaaagcgacaaggcaaaagccauugaaaggcuuguugauacguauaucauaacugacgagguggauaccucuggaaagacacagaaagaacaggucaaggaggacaagaaacggcugaaguccuuugcuaauuuggugcucggucugucagccagcuuaacugaucuguucggcaguguagaagaccucgaugaggaccuuaaaaagcugcagauuaucggggauaccuacgacgagcgucgcgaugacuuggcaaaaguuuggggagacgaaauucauaucaucgaugacuguaagucuguguaugaugcuauuauacuaauguccaucaaggagccgggccugacaauuagcgaaucgaaagucaaggccuucaaaaagcacaaagacgaucucgcgauccugaagucucuucugaaguccgacagaucaauauacaacaccauguuuaaaguggaugagaaggguuugcauaauuaugugcacuacauuaaacaagggaggacggaagagacuucaugcaaccgggaggacuucuacaaguauacaaagaaggucguugaaggacuccccgauagcaaggacaaagaguacauccuguccgaaaucgaguuacagacccugcuaccucuccagcgaauuaaggauaauggcgugaucccauaucagcugcaccuugaagaguugaaaguaauucuggccaaguguggccccaaauuuccuuuccucaacgagguggcagacggguuuucugucgcugaaaagcugauaaaaaugcuugaguuccgcaucccauacuaugugggaccccugaauacucaucacaacguugauaaugguggcuuugccugggcugugagaaaggccagcgggagggucacaccuuggaacuucgacgacaagauugaucgggaaaaaucagcagccgcuuuuaucaagaacuugaccaauaaaugcacguaccuccugggagaggacguguuaccaaagaguucccugcuauauagcgaguucaugcuccugaacgaacuuaauaacguacgcaucgauggcaaaccguuggagaaggcgguuaaggaacaucugauugaggcaguguuuaaacaagaccacaagaaaaugaccaagaauagaauagaacaguuccucaaagauaacaauuacauccccgagaagcauaagccugagauuacaggucuggacggggaaaucaaaaacgauuuagccucuuacagggacaugguccguauucugggcaauaacuuugaucuuucaauggcugaggaaaucauaacugacaucaccauuuucggagagaguaagaaaauguugcgggaaacacuccgaaauaaguucagcuccagacuggaugacgaggccaucaaaaagcuaucuaagcugagguaucgcgauuggggccggcucucgagaaaacugcuuaacgugauugaggggugugacaaggcaggagacgguacuccagaaaccaucauaauuuugaugaggaauuuuagcuacaaccugauggaguuacucggcgauaaauucuccuuuauggaacgcauccaggagauuaaugccaagcugaucgaagggcaaauagucaacccccacgacaucauugaugaccuugcucugaguccugccgugaaacgagcaguuuggcaggcguugcggaucguggaugagauuguacacaucaagaaaacacucccagcucguauauucgucgaggugaccagaaguaacaaggccgaaaagaaaaagaaagacucuaggcagaagcgccugagcgaucuauaugcagccauuaaaaaggacgaugcucugcucuccggacugacuaaugaggaauuuggcggucuuaagucaggguuggccaaauacgacgaugcagcucugcggagcaagaaauuauaucucuacuauacgcagaugggcagaugcgccuacacaggagagguuaucgaccugucucaacuuaacaccgacaauuacgauaucgaccauauuuaucccaggucccugacuaaggaugacaguuucgauaaccuagugcucuguaaacgaaccgcgaaugcccaaaagagcgacacauacccgaucucuaaggagauucagaaagcucagaaggcauuuuggauauuccugaaacagcagggcuugaucuccgaacgcaaguaugagcggcugaccagaauuacuccuuuaacagccgaugaccucucaggguuuaucgcuaggcagcuggucgaaacgaaccagagugugaaagccgcaaccacucuucugcgucgcuuguaccccggaguagaugugguuuucgucaaggcggagaaugugacagacuuucggcacgauaacgacuucauuaaggugagaagccucaaucaucaccaccaugccaaagaugcuuaucugaacaucgucguugguaauguguaccacgaaagguuuacccgaaacuuccgggccuucuuuaagaaaaauggcgcaaaccgcacauauaaucuagcuaagauguucaacuacgacgugaaaugcacuaacgccaaggacgggaaggcaugggccguaaaaaccucgauggauacggucaagaaaaugauggacuccaaugaugugagaguuaccaagaggguguacgagcaaaaaggacagcugucugacauaaaccuuacaaaggcuagcaaagucaaggcggauaucuaucucccaauuaaggccaaugacccuaucaugucacagaacaugaaauacggcgguuauagugauauuaagaaugcauacuauacuaucauagaguacuccgacaaaaagaacaauucuauuaaggcuuuuauccccaucccaauuuucauagccaccaagacacugacuaagcaggccuugcuggaauauaucaaaaccguguuacccaaggcuaacaaucuccggauuaucuacaaaaagguuuacaacgaucaacugcuuaaaauugacggguuuaauuauuaccugggcggacgaagcaacgauagauucuguaucgacaaugcaauacaguugaucgugccucucgagauucaguuuuauaucaagcugguagaaaaguucacggccauuaucuccgagaacaaaaauauagcgcuaaaggcuucaagcgucaaaagucgcaacccaauuaacaaucaaguggaaaacaucacacuggaguacacccagaaacuuuuugauuaucucgugucuaaauucaaugagcugaucuacuugaagaugaggggcaacaaguuaacugacgucaauaacauugggcguaaacaguuuaucaagcugucccucgaggagcggugcaaagcccuggcagaacuucugaauauauucacaaacaugaauaagaaauugagccuaucgaccauuaacguuucagccucuagaaaggugguaaauuucaaaaucaguucccuggacgaguuuaagauugugaacgaaagcaucacuggacucuauucucaugagauaaccauugucuga

SEQ ID NO: 3266 - RNA, 4188 nt, Artificial Sequence
  Cas9 variant
augaaccugagaaauaccacagacgaguacaacaucggccucgauauggggacuaauagcgugggaugggccgucacggacaagguuggugcuauugcacacuucaaaggcaugcccacccuuggguccaggcuguuugaugccgcgcagacagcugccgaagcacgggcccaucgcggacaacgacguagauaugugaggcggcgcuggagauuggacuuacugcagucucuauuccaggaugagauagacaagguagauucagaauuuuucaucaggcuccggcagagucgccugcacguggaggaccgagaagauggccaugcugacuacaaauggccuauuuuuaacgauagcgacuucacugaggucgauuauuacaagagauuuccaaccaucuaucaccuuaggaaauggcugauugagacagaccaaaaggcagacauccgguugauauaccucgccgugcauaauaucguuaagcaccgugguaacuuccugcgcgaaaauaacaaaaaucuguccucuagaaacgcugauccggccgaggcgguggggcaccucagguuagcacugaauaacuggugccuugaacggggauaugagugugccuggaagucgggcggcaaugacaacgcuauuuugaauguccugaucgauggggagaaacgacgcucagaccaggugagagaaauugccaagcuaaccggaaucgauugcggugacgcaaaacagagcaggcaguguaacgaggcuauagccaaggcgauuguaggccucaaggccgaaaugaaaaacaucuuuggggaguuccccgcagaaaagacucugauuuaccuuaguuccgaugacgauguugaggugguccgggacgcuugcccugaugacucuguggagcuguuucaagccuugugugaacucuacgcugccuauauccugcagggauuacugagcuacgcaccaggccagacaaucuccgugaauauggucaaaaaguaugaccgcuacggugaggaucuccaucuucugaaagaauugaccagaacguaugccucaaagagguacgacgcuuucuuucguggggagacuuaugaaggaaguagcgauuacguuguggacaaagcgcagggcuacacccgguauaaccuaggcacaacucaacugucuuacgaugacuuccagaaggcaguaaaggaacucuucaaagggaccgaugcccugcaggacgagcgauaucaaggaaugaugguggcuuuuggugaacagagauuccuuaggcgccugaagacauccgauaauggcucaauuuacuaucaguugcaccucgaggaacugcaugccauauuagagaaccaggggaaacacuaccccuuucugcuagcagaagaggacaagaucgagagccucgucaguuuccggauuccuuauuacgugggaccacugaccagagaaaaugccgcuguuggccacgaugguaaagagagguuugccuggucuucccgccgagacgggauggaacaugcagugaucacgcccuggaacugggaggagauaauugaucgggacaagagcgcggaagacuucaucauccguaugacuggcgauugcacauaccuucaaggagagccugucuugccaaaguguucgcugcucuaugaagaguuuugcgcucugaaugaacuuaacggcgcccacuggaccauugacgaggaugacgagagaagguucgaugcagcccagcgcgaacggaucaugugugaccuguuuagaucuacuaggaaagugacauacaagaaaguauccgauugguuggagcgagaagacucauucguuggggcucgcgugcauggaggucagggcgagcacggguuugaaagucagcucggaagcuauauuuucuuuugcaaggaugucuucaaaaccgacucccuggaugaggccgacuacccgaugauagagcaaaucauuuuauggucuacgcuguucgaagaucgggacauccuaagaaggaagaucgaggaagcauauggcgaccgucucaccacagagcagauuaaggugauauguaaaaagcgcuuugcugguugggggcggcugagcaaaaaguugcuuacuggcaucaaagucgauaccgacacaggaagaaagucaauuaucgaugugcugagggaaggcaaucccaacgacgggcagcgaagucggacuaugguuuucauggaggugcuccgcgaugagggacuggguuuucagaaggccguagacgauuucaauagagacuacuuuuccgaacauaacaauggcuuaauggaugucaacgaccugccugggagcccagcgauuaggcggucuaucaaucaagccgugcgaauaguugaugagaucgugucaauugcuaaaaaggaacccgcaaacaucuucauugaggucaccagagaggaagacgacccucgcaaaaagggaaaaaggacaaagcgucgguaugaugccaucaaaagugcucuugagguguuuaagaaggacgauccacaguuguggaaagaacucaccaagaaagacagcaacaauauggaugagagacugucccuauacuucaugcagaggggcaagugcauguacucuggucgccccauaaaaauugaggagcugcacacugggaaguaugagguagaccacaucauuccgcgaucguacaucaaggaugacagccucgaaaacaaagugcugguuuauagagaggaaaaucagcauaagacggauacacuuuugauagacuccucaauccggaggaaaaugggcaaguacuggcgcaugcugcacaacgccaaauuaauuggagauaagaaguuucguaaucucuucagagaccauaucgaugacaaaaccaugaagggcuuugucgcacggcaaauuguggagacuucacagauggugaaacugguccagacccuucuggaagcgagguauccuggggcccgcaucguucccgugaaggcuaacauaucucacgacuugcgagaugccgcaggacucgugaaaugcagagaggcuaaugacuuccaccaugcccacgaugcauuucuggccugucggguaggccuauucauucaaaagaggcauccaagcgucuacgacaacccuaucggucuggcucacaucaugcgcgauuaugcgagagcccaggcaagggaguacaagaaaucccauuaccucgcucacacaaagggguucauugugaauaguuuucugagcucuggauucgacaaagaaaccggcgagguuuuuaaggaugacugggaugccgaagccgagguggaagguauccggcguguccuuaacuaucgccagugcuucauuucccgaaugcccguggaggcuacuggcacauuuugggaccagacgauauacaguccaaaaugugggaagaaauugacccugcccuuaaagagaggacucgauccugacagguauggcagcuacucucgggagcaauucgcauacuuuuucaucuaugaagcccgcgaucugaagcacgagagacauauucuucaguuugcgcagguuccagugaggguagcugcccacaucgcaaaagacccgucccagcuggaaucauaugccgucaagcuagcugggcaagcaaaucucgccuucgugcggauugugcgaagacgcauccugaaaaagcaguugcuggaguuaaacggagacaggcucauaaucacuggcguccgggagguucguaaugcgacagaauuugcuuucagucuggaugaggaaacccuuauugagagaugcgugcagaucgccaaaguagguagccugauugggguggucaacgacgaagaugaggagcaguugucggcagaccucaaugaacuguucuccucucuagugaagaggggacccaagcuguguaaccgccuuuacgcccaacucaaacuggauaaguacuugagcaaauuugacgagcugacauuaacugauaaggcuaaaguugugcuccagcugaucgccauaaccaacggcucaauuaauauggcagaccuuagugcucuggguuccucuaaguaugccggcugcaugcaggucagcuacuucaagcaauugaacgcgccuaucggggaagugaauaucauugaucaguccguuacgggaauguuugagcggcgaacccauauaggccucuga

SEQ ID NO: 3267 - RNA, 4188 nt, Artificial Sequence
  Cas9 variant
augaaggagaucaaagacuacauuauaggccuggauaucgggaccaacagcugcggauauguggucacagacaagcagaauaacauucucaaacuuaaggguaaaacugccaucggcgcuagacuguucaaggaagggcaagcagccgcggauaggcgguccuuucgcacgacccgacguagauuggcuaggcggcacuggcgcuuaggacugcuagaggaaauuuucgaccccgagauggaaaagaucgauccuaauuucuucagaaggcucaaagagucugacuacucaccaaaggauagucggaaacaguuuaacgccauaguuuucaagagcaucaaagcagacaagcgcuuuuauaagaaauacccgacaauuuaucaucugcgaaaugcccuuaugcacgauaaccagaagcaugaccugagagagaucuucauggcugugcaccauauuguaaaauacaggggcaacuuuuugcgggaagauuccgugaaugcauucaaggccgcuaaauuuucucuccguggugaggacgggaucggacccgucgauaagcugaaugaccugcucaaagaaauauauucggaguacucaccugaguuagccacuaacaaucugagcaagauugaagacaucauuaaggauaaaaaccuuuacaagcaggacaaauugaagcaaguggcgacccugcuaaucaaagaggcagauaguaaggacaaggccaaacucaauaaggauaucgcuaaacagguugccaacuccuucaugggcuauauguuucgccuggacacacuuuucucucugaccgauguggacgucaaggauuacaaauugaaguucagcgacgcaaauauugaugaaucccucgacgaccugacuucauuacugacagaugcucagauagaguuugugcucgaacuucagaguaucuauaacaccauuguacugaacgagaucguuccagacggcaugagcuugucugaguccaugauaaagaaauacgaugaccacaaggaagaucuaaaaauuuucaaggaguauaucgacucacugagcgaucagaaaaaggccaagaaacuccugagugcguacaaucuuuaugugaacuacagaaagucugaccuggucgaagccaaaaauuuguuuaagaacaaaaaggugggggauaaaaauuucgcagacgugaucuccaacuuugaggucuucggaaaguuuguuagcgauaaucucgacgauucggaacuggcuaacaagauuaaagccagguuagaccugggugaguuccuacccaagcagcggacgaaucagaacggcgugaucccuuaccagcuccaccaaguagagcugacucagauucuugaaaaacaggggaaguauuacccauuuuugauaacccccaauccuguggagucucaucgaaacaaugcuccauaugaaaucuccgagcuggucucauuccgcgugccguacuauguuggaccccucauugacaaccaaaguaucaaagauaagcagaauaagaacaaauuugccuggauggugagacagaagcagggccaaaucacaccuuggaaccuggaagagauggucgacacuaccgagagcgcaaaucaguucauuaaaaggaugacacggaaggauaccuaccuucuggccgaagacguguugccaaaauccucucucguauaucagaaguuuaugauacuggaugaguuaaaccgcaucaagauugacgguaaaaagcugacgagcgaacuaaaacacgauaucuucgagaaacucuucaaaaagcagaagucaauuaaucuggacaaccuuaaaaauuacuugcugguugaggggaacauccccggacucauagaaggccugagugauggcaucaauuuuaacaauuccuucagcacuuacauugacuauagaaacaucuuuggggaugagauugacaauccuaacaagcaagcugauuucgaaaagaugaucgaguggucuacaguguuugaagacaggaagauauucaaacguaaguuaaaagagauuaccuggcugacuucagagcagaucaagcaggucaguagcaagcgguacuccggauggggucgacuuucuaaaaaguugcucacacagauuaccgacgaaaauggcgugaacauccugcaaagacuauggaaugagccagaaacgcugaccgagguccucgcgaaccccgugauaaaaaggaagaucguugaagcaaacucgagcuuuacaaaagccaaggauaugaaggacauucugguggaggcuuauacuuccccgcagaauaaaaaggccauccgccagguaaugcgggucguggaugacauuaucgcagccgcucaugggaaaaagccuucacagauagccauugaguucgcaagagaagaucaagacaacccccagaugaccaaaaguaggaaggcgcagcuugaucaaaucuacgcuaagaucucugacgaguuuuuggaugacgccguuaaaaaugaacugaagaacaugaaagauaauaagccauuagcaaaagacaagguguuccucuauuuuaagcagaugggacgcgacgccuacagcggcgagaaacugucccuugauaaccugcaggacuaugauauugaccacaucuacccucagucauucauuaaggaugacagcuuugauaaucgagucuuggugcaacgggcuuacaacaaugguaaaucugacaacguacccgugcuccuguucgggaauaagauagccgcaggccuaggaaucacaauucgucagauguggaaaaaguggcuggaacucggccugaucuccaagagaaaauucaacaaucuuauuacugauccagagaagaucaguaggaacauggcuagcggguuuguuaaucgccaguuggucgagaccucucaggugauaaaacugguggccaacaucuuacaagcgaagcuccccgacacagaaauuaucgaggucaaagccuccuauaacucaauucugcggaaggaauuuaaucuuuacaaaaguagagagguuaacgauuaucaccaugcuaucgacgcauaccugaccacuauagugggaaauuaucuauaccagguguauccuaagcucaggccauacuuuguauacggucaguucaagaaauuuggcaaggccgagaaccaggaagaugacccggucaaaaagauuaaaaaguucaauuuuaucuaucaacugaucugggggaaggacgaugcuauuuguauaagccacacgaaccaacagguguucucgaaaaaggacaucauugauaaauugacaaccgccuacaauuuuaaguauaugaacaucucccaugcaguuuacacucgaaauaacaauauguucaaacaaacccuguuucccauuaucgagcgcacaaccgcgaagacuaagucuuuaauaccuaaaaagcucgaccggccaacagauaucuauggaggcuacagcaacaauaacgacgccuaucuggcucuugugaaagucgauaagaaaagagguucagaauacagggugguugggauucccaugcgugccgcagcuaugcugaaggccaguaagaauuacgacgaggauuugcgcaaagugaucgaaccuaugguaauguucgacaagaacggcaaagcaaagcggggaauugagggcuucagaguccucguggggaaaaugccauuuaagcaggccgugcuggauggaaauaaaaaguucaugcuaacggguaccgucgacacucccaaccugaagcagcuuguucucucccagcaaaacaugaaauauauccuggauuacauagaggacguggacugcaggaagcacaaauuuggcgauaagguacagaauccggacaaauguuugcuggaaguguucgaugagauuaucgaaaucgucgacaaguauuuugaguuauucgauucucgagacuuucgggaaaagcuccgcaacagcagaaauaaauucauuaagcuggaggcuuccaaaaaggcggauacaauccuugccauacugaaaggguugcaggcaaagucaaccagggcuacaauuaaggagcucaacaucagcgacuuuggacggauuaucaccaguucuauauccccugaagcccagcugauuuaccaaagcccaacuggccuauucgagcgaagagugaaaguuaaggaucuguga

SEQ ID NO: 3268 - RNA, 4188 nt, Artificial Sequence
  Cas9 variant
augagcaagaaauaccagaacaccaaguauuacgugggccuggacaucgggacauccucugucggaugggccguuacugaugcuaauuaugagcuccuuaaagugaacggucacaagacguggggcucaagacuguucaccgaagcagagacagccuuggaaaggcggacucaucgcgcgacccgacguagauuacaaaggcggaaacagcgccuggaccuacucgaugagcuguuugcugaggagcuugccaagguagacccccaguuccuguugagacucaaggagagucaguaccacauggaagauaaaagcacagacgauaaguaugugcuguuuaaugaccaaaacaggaccgauggggaguucuuuacugaauacccuacaauuuaucaucugcgguccgagcucaugcaggggaaaaaggaggacauacgcgcagucuacuuagcccugcaccauaucgugaaauaccgaggccacuuccuuuugccaggugauaauuaugacaugcaggggaaccugucugaacuaauuaagagacucuuuaaguucaucgaggaaacccuguuuauugaggaucuuggacugacggacgaaauccagucgaaaauagaggagaucuugcucacuaagaccaaaacaaggcuggaccggcaaaaggaaauuguuaaauuauucaauacuaagcaccagaaacuggaugacaagcagaagaaacuccuugaggcuaucuuuaagcugugcuugggccuaaaaggcaacauggugaauauuuucggggauaagggagaauacgguaucgacuuuaccgaugucgaggacaaaaagaagaaaguggaguucucagcagauuaugacaacaauauaaacgauuacguagacuucuuuggcgaauauuucgagcugcucgaaauuacaaagaaaaucaaugauaccguuauuuuuagcgagauccugguggacgggaagggauucagugaauccaaagucaucucuuacgagaagcaucagcaagaccuucguaagcugaaaacguugcucaagagccuggauaaaacuuuaggcuauaaguacggugaagggcuguaccagaaaauucuacucgacgaugugaaguccaacuaugugaauuacucaggaaacagucagaagcugaaaaaguguacaaaagacgaguuuuauggcuucauaaagagcaaacuuaacucugucaccaagaaagagaagguuuccgaagcccaacagaaggagaucgcucagauuuuggccgauauggaauuuggcgacuaccugccgcuccagcgcacuacagauaauggggugauccccaaccaacugcacaaaaaggagcuuauagagauuaucgaacagcagaccaaauaucaugacuucuuuaaugauguagacgagaacggacugacgaucaaggauaaaauuaucucauugaugaccuuccggauuccuuacuauguggguccacucaaugacuaccacaaggucgcggauggcacagggcacgcauggauagaaaagaaaaaggacggaaaaaucuaccccuggaacuuugacgagaugguggauacugaagccaccgcugagaaguucauuaaaaaucugacaaacaagugcacuuauuuaaagggcgaggacguucugccuaaagaaagcaagcuauacagugaguuuaugcuccugaaugaacuuaacaauaucaaaaucgauaaccagaaguuggacccaaaacugaagaugaagauggugucugaacucuucaugaaaaagaaugaaaagauuaccaagaaaaagauagucgauuaucugagguccaucggucaagccaacgggaaugagauggugagcggcauugaccgggagaucaaaucggauuuaaagacaauucauaagauccagcacuacuaucaggacgcaucucuggaaauggcugagaacauaauccgauggaacaccauuuucaaugauuccacuucagacauccuuaaagauaagauuacgaaagccuacggagacguauugacacccggccagaucaaggggcucaguaaccuggcguguaaagauuggggaaagcuaagcgaaaaguuucugaccgguauacgcugcgacguuggcgaguucaaaaauauuuccaucauucaagccaugagagacacuaacaauaaccucauggaacugcuuucuaauaaguaugaguuuauggauaaaauccaggaguacaacaaggaauacuauggggacuucaccuuuaaagcagagccuagcauaauggaugacuuguacgugggaccaggcccgaagagggcuaucuggcaggccguccggauuguggaagagaucaagcgcauuaugggucaugaucccgagaaaaucuuccuggaaacaaccagaacuaauagggcuccuaaggucaaaaacacaaagcguuaugacgccuuagagaaaaaguacgaaucagugaaggagcacgaauaugcagagguuaaaaaggaguuugaaauagagaaaaaugauagucucaacauuaagaaacuguuccuuuacuuuacgcagcuggggcauuguauguauuccgacgaaaagaucccauacaaugaguuguucaccaaccgguacgauaucgaccacauuuauccccgaagcaagacuagagauaauucuauggacaaccucgugcugguaaaagccgaaugcaacagggacaagaaagauaauuacccuaucaagcuaaaaacaaacauucaacagaagugucagguccgcugggcuuaucugcgggacaaaaagcucauaaccgaggagaaguacaauagacuggugaggaaaacaccacuuacugaagaugaguugucacaauuuaucgcgcgccagcugguuuucaccagucagagcgugaaggcaacggccgaagucuuuaaacgauuauaugaggacuccaagauuugcuacgugaaagcugaaaacguaucugauuuccgguauggcucgacccguaagaugagcaaggacgaucagccccaaccguucaucaaaaauagagacgugaacgauuuucaccaugccaaggacgcauaccucaauauuguugucggaaacguguacgaugugaaauucacacagaauccuacuagguuuaucaaggccaacaaagacuauucccugaauuacauauuccgcuaucccgucaacaagaagggcgagaauguuugggauccagagcagucaaugaaaaucguggaaaagacccuuaaaaguaacgacgugcggguaacaaagcuggucaaaccuauuacuucucccaucagcaaugagacccuacacaaggcucucaaguguaaaccaggguccuaccugcccagaaagucaagcaaaggaacgccuuuggccgacgugacaaaguaugguggcuacgagaaaauuaagaacgcauauuacucuaucuacaaauauaccuacaugaagaagaaagaaugcauggaggaauuucuguuaguuccaauaccgauucaucucgugaacaaugaugaggaacugcccaaguauaucaacgacaaaaucgcggagagggcuaagaaaaagaaacuugaaacugucgaguguauugugaaagagcuguaccaggggacauugguucgaauaaauggauaugauuaccgcaucgccggcuccagugguaagcaauucgaacuccacaacgggauuaaucugaucguggagccuuggguagaaaaaguccuaaaggagaccgacaaauuugugagaaagagcaacucuaagcuggauaaaaagcagcagaaagaaaauacuaccgagacacuuauugagaagcagcucaacgacguguucgaauaucugugcagaaaauugaaucaaggcaucuuuaagaacaauaagcacacgcugccagcaaaauuacucggagauuccauacagaagagguucgaggacgccucaaucgaagaugaguuugaagucauuaaagagcugaucagugcuauugccaagaacccccagaauuucaaaaccauccaaaagguucuugacauaagcggcucguccauuccucguuucaaccugaaauugacuaagaauaacguggaugaguuuaucaucaagaaugaaucuguaacaggacucuucacccaugagaaagugauuuuucgcaaguga

SEQ ID NO: 3269 - RNA, 4188 nt, Artificial Sequence
  Cas9 variant
augaagaaagagaucaaggacuacuuccugggccucgauguggggaccggaagcgucgguugggccguuacagacacugauuauaaacuucugaaggcuaacagaaaagacuuguggggcaugaggugcuuugaaacggcagagaccgccgaagugcggcgcuuacaccgaggggcgcguagaaggauugagcggcgcaagaagagaauaaaacugcuacaggaacucuucucccaagagaucgcuaagauugaugagggauuuuuccagaggaugaaagaaucuccccuguacgccgaggacaagacaauccuucaggaaaauacucuguuuaacgauaaagacuucaccgauaagacauaucauaaggcauacccuaccauuaaucacuugaucaaagccuggauagagaacaagguaaaaccagacccgcggcuccuguaucuggcuugucauaauaucauuaagaaacgcggccacuuucucuucgagggugauuuugacucagaaaaccaguucgauacaaguauccaagcauuauuugaguaccugcgagaagacauggagcuugacauugaugccgacagccagaaggugaaagaaaucuugaaggauuccucucugaaaaauucggagaaacagucaagacuaaacaagaugcucgggcugaaacccagcgacaagcagaaaaaggcuauaacuaaucuuauuaguggaaacaagaucaauuucgccgaucuguaugacaacccugauuugaaagacgcggagaaaaauuccauuucuuuuagcaaagaugacuucgaugcacucuccgacgaccuggccucaaucuuaggcgauaguuucgaacugcuccuuaaggcuaaagccgucuacaacugcagcgugcugucuaagguuaucggcgacgagcaauacuuguccuuugcaaaggugaaaauuuaugaaaagcauaaaaccgaucuaacgaagcugaaaaaugucauaaagaagcacuucccaaaagacuacaagaaaguguuuggguauaacaagaacgagaaaaauaacaauaacuacucagcuuauguaggaguuuguaagaucacucacaaaaagcucgugauuaagaauagcgccagucaggaagauuucuacaaauuucugaagaccauccuuucugcgaaauccgagauaaaggaggucaacgacauucugacagaaaucgagacugguaccuucuugcccaaacagaucagcaagucgaaugccgaaauuccuuaucagcucaggaagauggagcuggaaaagaucuuaucuaacgcagagaagcauuuuuccuuccugaaacaaaaggaugagaaaggccuaucacacagugaaaagauuauaaugcuccugacauuuaagaucccauacuacauugggcccaucaaugacaaccauaaaaagagcuucccugaucggugcuggguggugaaaaaggagaaauccccaucuggaaagaccacgccguggaacuuuuucgaccacaucgauaaggaaaagacugcugaggaguuuauuacaagccguaccaauuucuguacuuaucuuauaggcgaaucagucuugcccaagaguucccugcucuacagcgaguauacaguucugaaugaaaucaacaaucuucagauuaucauugacgguaaaaacaucugcgauauaaagcugaaacagaagaucuacgaggaauuguucaaaaaguauaagaaaauuacccaaaagcagaucucuacguuuauuaaacacgaggggaucuguaacaagaccgacgaggugauaauucucggaaucgacaaagaaugcacaucaaguuuaaagagcuacauugaguuaaagaauaucuucggcaaacagguagaugaaauauccacuaagaacaugcuggaggaaaucauucgcugggccaccaucuaugacgagggcgaggggaaaacaauucuaaagacuaaaaucaaggcugaauacggaaaguacuguucugaugagcagauuaaaaagauacucaaucugaaauuuucggguuggggcagacuuagcaggaaguucuuggaaaccgugacauccgagaugccuggguuuucagaaccagucaacaucaucaccgccaugcgggagacucaaaauaaccugauggagcuccugaguucugaguucaaauuuacggaaaauauuaagaagaucaacagcggauucgaagacgcagagaaacaguuuuccuauaauggcuuagugaagccccuguuccuuucaccuagcguuaaaaagauguuguggcagacacucaaacuggugaaggagauuucucauauaacccaggccccacccaagaaaaucuuuauugaaauggcuaagggugcggagcuagaaccggcacgaacuaaaacccgccugaagauccuccaagaucuguacuccaguugcaaaaacgacgccgaugcuuucagcucugagauucaguaucuuuccgggaagaucgaaaaugaggacaacuugagacugaggucagauaaauuauaccucuauuacacacagcugggcaaguguauguauugcggaaagccuauagagaucggccacgucuuugacaccaguaauuacgauauugaccauaucuacccccagagcaaaauuaaggaugacucgaucuccaaccgggugcuuguaugcucuagcuguaauaaaaacaaggaagacaaauauccacugaaggccgagauacaaucaaagcagcgcggguucuggaacuucuugcagagaaauaacuuuauuagucucgaaaaacugaauaggcuaacucguacauccccuaucucugaugacgagacggcaaaguucaucgcccggcagcugguugaaacccgacaagcuacuaaaguggccgcaaagguccucgagaaaauguuucccgagacaaagauuguguacagcaaggcggaaaccgucuccauguucagaaacaaauuugauauaaucaagugcagggagauuaaugacuuccaccaugcucacgaugccuaucugaacaucgugguuggaaauguguacaacacaaaauuuacuaauaacccauggaauuucauuaaggaaaaacgcgacaaccccaagaucgcagauaccuauaauuacuauaagguauuugacuacgaugucaaacggaacaauauaacggccugggagaaggguaaaaccaucauuacagugaaggacaugcuuaaaagaaacacuccuaucuacaccaggcaggcugccuguaagaaaggcgaauuguucaaccagacaauuaugaagaaggggcugggacaacacccacugaaaaaggagggcccgcucucaaauaucagcaaauaugguggguacaacaagguuagugcagcuuauuacacucugauagaguaugaagagaaaggcucuaagauucgcucccuugaaaccaucccccuguaccuagugaaggauauccagaaaaauaaggacggacucaaaagcuaucugacggaccagauuggcaagaaagagaucaagauauugauuccuaagaucaaaauuaacucgcuguuaaagaucaauggguuuccaugccauauaacaggaaaaaugggugaggccuucguccuccgacccgcggugcaguucuguugcucaaacgaugaagcccuguacuuuaagaaaauuauccgguucaaugagauccguaagcaaagagaaaagaugggcaaaaccauuucuccuuacgaggaccuuaguuuuagguccuauaucaaggauaaccuguguaaaaagacuaaagcugacgaaauugaggagaaggaguucuacgauuugcuccagaaaaagaaucuggaaauauaugacaugcuacugacaaagcacaaagauaccaucuacaagaaacgcccaaacagcgcaacuauugacauccuuguaaaggggaaagaaaaguuuaagucucucaucauugagaaucaguucgaagugauacuggagaucuugaaacuguuuagcgccacccggaacguuuccgauuuacagcauauuggaggcucaaagaaugcugguaacgccagagucgggaauaaaaucaguagccucgacaacugcauucugaucuaucaaucuauaacaggcaucuucgagaagaggauugaucuucugaaaaucuga

SEQ ID NO: 3270 - RNA, 4188 nt, Artificial Sequence
  Cas9 variant
augagcuucaagaaaauccugggccucgacgugggggucgccuccauuggaugggcuguugugagagagaacgaagagaaucccaacuuuaauaccauaacaaaacuugguguaaggguggucccuaucacuucugaugaaaaacugaacuucgagaagggcaaaucaauuacgaguaaugcagaacggaccuuggcccgcagcucccgacguaacuuacagagauuuaggcugcggcgcaagaaucuaaucgcgauucuccugcaaaaccagaucauaacaccaacuaccccgcuuacagagaaggggaaauucaccacuuuugagacacugaagaucagagcuaaagccaccaaggaaaagauugaguuggaggaacucgcaagggugcugcugcacaucaauaagaagcggggauacaaaucuucgcgcaagguuaaaaacucagaggacggcaaggccauugaugguauggaagcugcaaaaauccucuaugagaauaaguuaacgcccgggcaguacacuuaucagcugcuugaaaaaggaagcaacaagauaccugacuucuacugcagugauuugcaaauugagugggaagugaucuggaauuuucagaagcaguucuauccaaaccugcuaaccgaggacuuuaaaaaggagcucaaaggcauuggccagcgagccacagcugcccuguuccuuaagaaauacgggaucuauacugcgcugaauaagggaaagagagaagagaaaaaguugcaagcauacaaauggagguccaagucugucagcgagaaaauccccguggaagaacucgccuacguaauugcugagauaaacucccauaucaccaacucaagugguuaucugggcacaauuagcgaucggucuaaggaguuauacuuuaaucagcagaccaucggggaaaaccuguaugcccagguugcaaagaauacgcacgcuaaacucaagaaccaaguguuccuucgucaggacuacuccgccgaguuugaacagauaugggagacucaagcgaaauuccauccucagcugacaccagaauugaagaaaaagauucgcgauucaaucaucuucuaucagagaaagcuaaggagccagaaacggcugauuaguaucugugaguuugagaaucgagaaauugagauaaucaagaacggcaaaaagaaaaagaaaaagauuggacucaaggccgcacccaaaucuuccccucuguuccaagaauuuaagaucuggcagguccuuaauaacaucgugauuaaacaggaggguaaggaccgccuguugaccugggaggaaaaagagcuccuguucacugaauuaaauauaaaggggaacaucagcggacagaaggcucuggcccuacucaaacugucgccaaaggauacaaaaauuaaugugaccauccuugagggcaaccacacgcaagaacaguuguacagagucuaucugaggauucucggcauggagggguacgacguuuuugaucugcuuaagaucccggagaaucaggacgaaauaaaacccgcugacucuaagaucuccgccgcagagauuaaggaaaccgugaaaucaguauucaagacaugcaguaucagcccuuccauucuggauuuugacccauugcuccccaacccugaguucgaaaaucagucuagcuaccaacuguggcauuuacuguauucauacgagggagauaguuccccaagcgguaacgagaaacuacucgaacugcuuaagaacaaauuuggcuucaagaaggagcacgccuugcugcucgcuucuaucucauauacuuacauauaugggaaucugaguagcaaagcgaugcggaagauuuaccccuauuccaaagaaaacaccuacucugaggcauguauguuagccggauaccgccacucgaagaaugcucugccgagagaggaacuugugaaauaucaguugaaggacaggcucgagauccugccuaaaaacagccuacguaaucccgucguggaaaagguucugaaccagcucauuaaucuggugaacucccuuauggaugaguacggcgccuuugacgaaauccgguuggagauggcacgagagcugaagaaaaaugccaaggaaagagagaaauggucaaagaacauagcugaugccacaaguaggaaucagaaacaugcagaaaucuuaaagaaggacuucaaaauuucuaacccaagcaagaaugaucucauccgcuaucggcuguaccuugagcugaaagcgaacgguuauaaugacuuguacacuaacaccuauauugauaucaacuaccucuuuacacacagauacgacauagaccauauuaucccucaauccaagguccuggaugacucauucagcaauaaagugcuaguacccaggcaggcuaaccuggaaaagucuaaucucaccgccuucgauuauaucucccaccaggggaaggagaaagaggaacacuaccugaacguuauuacugagcuuuauaagcgcggcaguaucagcgaaacgaaauacaagaauuugcagaaaaagggaaacgagauuggcgaaggguuuauaaaucgagaccugaagaacacacaauauaucgugcggaaagcacgugagauuuuaucucucaucaccccaaaugucgugacuaccacaggagagauuaccgccaagcugagaaaagauuggaaccuuaucaauuccaugaaggaacugaacauggacaaauucaggaaugcucgccuaacugagcucgucgaaaacucacggggugagaagaaggaaauaaucauugauuggaauaaaagaaacgaccagaggcaucacgccaucgaugcacuggugguugcuuuuacaacgcgaaaccaugugcaguacuugaauuauaugaacgcccgcgaggacgagagucacaagcaacauagccacauucugucgaucgagaaaaagauaaaauacgauaaguuccacgaaaauggcucccggcagucuagauuuauuuaccccaccagcaacuucagggaagaggcgaaaaagaaguuaaaagagauccucguaucauauaagacuaaaaauaaggucgugacaguuaacaucaauaaaccuaagaagaaagggggauacaguccaaagcaugaacugaccccgcguggcccccuucacaaagagacaauuuaugguaugauacgcauccugcauacuaaggaaauuaaaguguccucuaaguugaacuuugagaccgucgugcggauccagaauccuagauacaggaacgcccuccuggaacgacuaaaggacaauuucaacgaucccaaaaaggcuuuuagcgggaccaauucccugacgaaaaacccaguauuccuuacagcaaauucaacugagaccgugccugagaagguuacaauucagugguuugaaaaagucuauacuauccggaagccaauaaaccccaccaauuucaagaacgagaaaaacaucgaaaaggugcucgacccgacgauucgcacacuguugaaaaagagacugcaagaguacaauggcaacgccaaagaggcuuuuagcgacuuagaaaagaauccuaucuggcucaaccaggagaaaggaauuugcaucaagaccgugacuauaacaggcauuaguaaugucgaaucucugcacaccaagaaagaucacuucgggaaggagcuucuggacaucaacggaaauccaauccccguugauuucguguccacugguaacaaucaucacguggccauuuaugaagacagcgagggcaacuugcaggaaaaaguagucucguuuuacgaggcaguggagaggguuaaucaggggcucccugugaucgauacccuguacaaccuagaccugggauggaaguuccuuuuuacaaugaaacaaaaugaaauguuccucuuucccgcggaugacuucgauccaaacgacauagauauuuaugacgagaagaaucugaucuugauuucaaagcauuuauuucggguccagaaacugucuaguaaggauuacuguuuccgacaccaucucgaaacguccaucaacuuuaacgacccugcccugaaaggcauaaccuggagacgcgagagccccaauggucuuaggaaccuggugaagguucguuugaaucaccuagggaaaauugugcacaucggcgaguga

SEQ ID NO: 3271 - RNA, 4188 nt, Artificial Sequence
  Cas9 variant
augaagaaagagaucaaggacuacuuccugggccucgauguggggaccggaagcgucgguugggccguuacagacacugauuauaaacuucugaaggcuaaccacaaagacuuguggggcaugagaugcuuugaaacggcagagaccgccgaaaagaggcgguuauuccgcggggcgcgacguagaauugagaggcggcgcaagagaauaaaacugcuacaggaacucuuuucccaagagaucgcuaagauugaugaggacuucuuucagaggauggaagagucucccuucuacgccgaagauaaaacaauccugcaggagaauacucuuuuuaacgaccgggauuucaccgacaagacauaucauaaagcauacccuaccauuaaucaccugaucaaggccuggauagagaacaaggugaaaccagauccgcgcuugcucuaucuggcuugucauaauaucauuaagaaacgaggacacuuucuguucgaaggcgacuuugauucagagaaccaguucgacacuucuguacaagcacucuuugaauacuuaagagaggacauggaacuggauaucgacgccgauagcaagaaaauuaaggagauccuuaaagacuccgcuuugaagaauagugauaagcagaacaggcugaauaaacuacucggucugaagucgucagacaaacagaagaaagcccuuacaaaccugauaagcgggaauaaggcgaacuucgcagauuuguaugacaaucccgaucucaaggacgccgagaaaaacaguauuuccuucucuaaggaugacuuugacgcucugagcgaugaauuagccuccgugcugggagacucauucgagcuccuucugcgggcaaaagcugucuacaauugcaguguguugagcaagguuaucggcgaugaacaguaccuaucuuuugccaaagugaagauuuaugagaagcauaaaaacgaccugaccaagcucaaagaagucgugaagaaauacuucccuaucgaguaucguaacaucuuuggcuacaagcaauccgagaauaacaauuguaacuauucacgcuacguagggguuugcaagagcggaaguaaaaagaaagugauuaauaagacggcgucucaggaagauuucuauaaauuucugaaggacauacuucugaaaagauccgaugucccagaggccaacgguaucuugacugaaauugagaccggcacauuccuccccaagcagaucagcaagaauaacgcagaaauaccuuaccagcugaggaaaauugaguuagagaagauccugacuaaugcugaaaaauuuuucucguuucuaaagcaaaaagacgagaacgggcucucucacuccgaaaagaucauuaugcugcuuaccuucaagaucccauacuauauuggacccauaaauacaucacacaaacaguacuuuccugaucggaguugggugaucaagaaagagaacgccccacaggagaagauuaccccguggaauuucuucgaccauaucgauaaagaaaagacggcugaggccuuuaucacuagccgaacaaacuucuguaccuauuugauuggcgaauccgugcugcccaaaaauucucuccuguacagcgaguauacuguccuuaacgaaauaaacaaucugcaaaucauuaucgacgguaagaacauuugcgauguuaaguugaaacagaagaucuacgaggagcucuuuaaaaaguauaagaaagugacacagaagcagauaucaaccuucaucaaacacgaagggauuuguaauaagacggacgagguaaucauucugggaaucgacaaagaaugcaccaguuccuuaaagagcuacauagagcugaaaaacauuuuuggcaagcaaguggaugaaaucucuacaaagaauaugcuagaggacauuauccgcugggcaacuauauacgaugagggcgaagggaaaaccauccucaagacaaaaauuaaggccgaguaugaaaaauacuauucagacgagcagaucaagaagauucugaaccuuaaauugaguggaugggguagacugagcaggaaguuccucgaauccaucacuucugagauaccuggcuuuauugagccagucaauaucaucaccgcuaugcgggaaacacagaacaaucugauggaguuacugucgagcaaauucaaguuuaacgaaaauauuaaaaagaucaacuccggguucgaggauaccgacaagcgcuuuucauacaauagucuugugaaacccuuguuccucucuccuagcguuaagaaaaugcuguggcagacucuaaagcuggugaaagagauuucccauauaacgcaagcgccacccaagaagaucuuuauugaaauggcaaaaggagccgagcucgaaccggcuagaacaaagaccaggcugaaaauccuucaggauuuguauaacucauguaagaaugacgccgaugcauucagcucugagauucaguaccuguuaggcaaaaucgaaaacgaggacaaccuccgucugcgguccgauaaacuuuaucuguacuacacucaguuggguaagugcauguauugugggaagccuauagagaucggccacgucuucgacaccaguaaguacgauauugaccacaucuauccccaaagcaaaauuaaggacgauucuaucaauaaccgagugcucguaugcuccucaugcaauaaaaacaaggaagacaaauacccacugaagccugagauacagcuaaagcagaaaaaguuuuggaauuuccugcagagaaacaauuuuauuaguaucgaaaaauucaacaggcucacacgcaccacucccaucagcgaugacgagacagccaaguuuauugcucggcaacugguugaaacgagacaggccaccaaaguggcagcgaagguccuugagaagauauucccagagacuaauaucguguauucgaaagcugaaacagucuccauguuuaggaacaaguucgauauuaucaaaugucgcgagauuaaugacuuucaucacgcccaugaugcauacuugaacaucgugguuggaaauguguauaacaccaaguucacaaauaaccccuggaacuuuauaaaagaaaagcgagacaauccuaagaucggcgauacuuacaacuacuauaaaguauucgacuacgaugucaagcggaauaacauuaccgccugggagaaagaaaagacgaucauuaccgugaaaacaaugcugaagcguaauacuccaaucuauaccagacaggcugccugcaagaaaggggaguuauucaaccaaacaauaaugaagaaaggacucggucagcacccgcugaagaaagagugucccuuuucuaauauuagcaaguacggcggguauaacaaaguuucagcagcuuacuauacuuucaucgaauacgaggaaaagggaaauaagaucaggagucuugagaccauuccucuguaccuagagaaagacauccagaagucccaggacggccucaaagguuaucugacggaucaauuggggaagaaagaaauaaagauucuggugccaaagaucaaaauuaacucuuuacucaagaucaauggcuuucccugccauauaacaggaaaaaccggcgccagcuucguccugcgcccugcggugcaguuuuguugcuccaacgacgagguacuuuacuucaagaaaauuauccgguuuaaugaaaucagaucacagagggagaagauggggaagacuauuagcccauaugaagaucugaguuuccgaucuuacaucaaagagaacuuguguaagaaaacaaagaaugacgagauuggagaaaaagaguuuuaugguuuccuccagaagaagaaccuggaaauauacgauaugcuacugaucaaacacaaggacaccauuuauuccaaacgccccaauagcacuacccuugauaugcucaucaagggccgguacgaguuuaucaaccugaaaccggaagaccaaauuagagugauguuggagauacugaaguuauucugcacaacgagggagguuaucgaucucgggcugauuaaaggaaagucggaagccggcgucaccacucuugguaagaaaaucucaaaccuggacucuuguauuuugaucuaccagaguauaacagggaucuuugagaagcguauugaucuccugaaaaucuga

SEQ ID NO: 3272 - RNA, 4188 nt, Artificial Sequence
  Cas9 variant
augaagaaagagaucaaggacuacuuccugggccucgauguggggaccggaagcgucgguugggccguuacagacacugauuauaaacuucugaaggcuaacagaaaagacuuguggggcaugaggugcuuugaaacggcagagaccgccgaagugcggcgcuuacaccgaggggcgcguagaaggauugagcggcgcaagaagagaauaaaacugcuacaggaacucuucucccaagagaucgcuaagacagaugagggauuuuuccagaggaugaaagaaucucccuuuuacgccgaggacaagacuauucugcaggaaaaugcacuuuucaacgaucgggacuuuaccgauaaaacauaucauaaggccuacccuaccaucaaucaccugauuaaggcuuggaucgagaacaaaguaaagccagacccgcgcuugcucuaucuggcaugucauaauauaaucaaaaagcgaggccacuuccuguuugagggugauuucgacucagaaaaccaguuugauacaaguauucaagcccucuucgaguacuuaagagaagacauggagguggacaucgaugcugacagccagaaagucaaggaaauucugaaagauuccucucuuaaaaauucggagaagcagucaagguugaacaaaaugcuggggcuaaagcccagcgacaaacagaagaaagccaucacuaaucucauaaguggaaacaagauuaauuuugcggaucuguaugacaacccugaucuuaaggacgcagagaaaaauuccaucucuuucagcaaggaugacuucgaugcccuguccgacgacuuggcuucaauucucggcgauaguuuugaacuguuacugaaagccaaggcaguguacaacugcagcguucucucuaaagugaucggcgacgagcaauaccuuuccuucgcuaaggucaagaucuaugaaaaacauaagaccgaucugacgaaauugaagaaugugauuaaaaagcacuuuccaaacgacuacaagaaaguauucggguauaacaagaaugagaaaaacaauaacaauuacucagccuauguuggaguguguaagacuaaaagcaagaagcuagucauaaacaauaccgugaaccaggaagauuuuuacaaguuccugaagcccauccuccuggcgaaaagugagauuaaggaggugaaugacauccuuacagaaauagagacugguaccuuucugccuaaacagauuucuaaguccaacgccgaaaucccauaucaguugcggaaaauggagcucgaaaagauccugagcaaugcagagaagcacuucucguuuuuaaaacaaaaggaugagaaaggccugucucauuccgaaaagauuaucaugcuacucacauucaaaauucccuacuacauagggccuaucaacgacaaucacaagaagucauuuccagaucguugcugggucauuaaaaaggagaaaaguccgagcggaaagaccacgcccuggaacuucuuugaccauaucgauaaagacaagacugcugaagccuucaucacaucccgcaccaauuucuguacuuaucugguuggcgagucugugcuuccuaagaacagcuugcuguacucagaguauacaguacucaacgaaauuaauaaccugcagauaaucauugaugguaaaaauaucugcgacauuaaacuuaaacagaagaucuacgaggaacuguuuaaaaaguauaaaaagauaacccaaaagcagaucaguacguucauuaaacacgaggggaucuguaacaagaccgacgaagugauuaucuugggaauagauaaagagugcacauccagccucaagucuuacauugagcugaaaaauaucuuuggcaagcaggucgacgaaauuucaacuaagaacauguuagaggaaaucauaagaugggcuaccaucuaugaugagggcgaagggaaaacaauucugaagacuaaaaucaaggccgaguacggaaaauacuguagugacgagcagauuaagaagauccuaaaucucaaauucagcgguuggggcaggcugucccggaaguuucuugaaaccgugacaucugagaugccaggguucucggaacccguuaacauaauuaccgcaaugcgagagacucaaaauaacuugauggaacugcucagcuccgaguuuaaauucacggagaauaucaagaaaaucaacucaggauuugaagauguggagaagcaguucaguuaugacucucuggucaagccuuuauuucugagcccauccgugaaaaagaugcuuuggcagacauugaaacucguaaaggaaauuucacacaucacccaggcucccccgaaaaagauuuucauagagauggccaagggcgcggagcuggauccuguucgcacuaaaaccagacuaaagauccugcaagaccucuacaauaacugcaaaaaugaugcagacgccuuuagcucugaaauuaaggaucuguccgguaaaaucgagaacgaagacaaccuuagguugcggagugauaagcuguauuuauacuauacacagcucgggaaauguauguacugcggcaagcccauugagaucggacauguguucgacaccagcaauuaugacauagaucacaucuacccacagucuaagauuaaagacgauuccaucucaaaccgcguccuggugugcaguagcuguaauaagaacaaagaagacaaguacccucuuaaagcugagauucagucgaagcaaagaggcuucuggaauuuucugcagaggaacaauuucaucuccuuggagaagcucaaccgucugacucggacaucucccauaagcgaugacgaaacggccaaauuuauugcacgacagcuagucgagaccagacaggccacuaagguggcugccaaaguucuggaaaagauguucccagagacaaaaaucguguauucaaaggcagaaaccguaaguauguuuaggaauaaguucgauaucauuaaaugccgcgagauaaacgacuuucaucacgcgcaugaugcuuaccucaauaucgucguggggaacguuuauaauacaaaguucacuaacaaucccuggaacuuuauuaaagagaagcgggacaacccuaaaaucgccgauaccuacaauuauuacaagguguucgacuaugacgucaagagaaacaauauuacggcaugggaaaaaggaaagaccaucauaacagugaaagauaugcugaagaggaacacuccaaucuacacccgccaagccgcuuguaaaaagggugagcuuuuuaaucagacaauuaugaaaaagggcuuggggcagcacccgcugaagaaagaaggacccuuauccaacaucucuaaguacggcgguuauaauaaaguaagcgccgcauacuauacucucauugaguacgaagagaagggguccaaaauccgaucacuggagaccauaccucuuuaucuggugaaggacauucaaaagaacaaagauggccuaaagagcuaccucacggaccagaucggaaagaaggaaaucaaaauucugaucccaaagauaaagauuaauaguuugcugaaaaucaacggcuuccccugccacauuacagggaagaugggagaggcuuucguuuuacggccugccguccaguuuuguugcucuaaugaugaagcgcucuauuucaaaaagaucauacguuuuaacgagauuagaaaacagagggagaagauggguaagaccaucuccccauacgaagaccugagcuuccgcucguacaucaaagauaaucuuuguaagaaaacuaaggccgacgagauugaagagaaagaauuuuaugaucuguugcaaaagaaaaaccucgagaucuacgacaugcugcuaacaaagcauaaggauaccauuuauaaaaagcggcccaauucagcuacuauagacauccuggugaaaggcaaggagaaauucaagucucuuauuaucgaaaaccaguuugaggugauccucgaaauucugaaguuguucagugcaaccagaaaugucuccgaucugcagcacauagggggaagcaaaaacgccggcaacgcuaggguugguaauaagaucucuagcuuagacaacugcauucucaucuaccaguccauuacagggaucuuugagaaacgaauagaccugcuuaagaucuga

SEQ ID NO: 3273 - RNA, 4188 nt, Artificial Sequence
  Cas9 variant
augaagaaagagaucaaggacuacuuccugggccucgauguggggaccggaagcgucgguugggccguuacagacacugauuauaaacuucugaaggcuaacagaaaagacuuguggggcaugaggugcuuugaaacggcagagaccgccgaagugcggcgcuuacaccgaggggcgcguagaaggauugagcggcgcaagaagagaauaaaacugcuacaggaacucuucucccaagagaucgcuaagauugaugagggauuuuuccagaggaugaaagaaucucccuuuuacgccgaggacaagacaauccugcaggaaaaugcacuuuucaacgauaaagacuuuacugauaagaccuaucauaaggccuacccuacaauuaaucaccugaucaaggcuuggauagagaacaagguaaaaccagacccgcgguugcucuaucuggcaugucauaauaucauuaagaaacgcggccacuuccuguuugagggugauuucgacucagaaaaccaguuugauaccaguauccaagcccucuucgaguacuuacgagaagacauggagguggacauugaugcugacagccagaaggucaaagaaauccugaaggauuccucucuuaaaaauucggagaaacagucaagauugaacaagauacuggggcuaaaacccagcgacaagcagaaaaaggccauuacuaaucucaucaguggaaacaagauuaauuuugcggaucuguaugacaacccugaucuuaaagacgcagagaaaaauuccaucucuuucagcaaagaugacuucgaugcccuguccgacgacuuggcuucaauccucggcgauaguuuugaacuguuacugaaggccaaagcaguguacaacugcagcguucucucuaaggugauuggcgacgagcaauaccuuuccuucgcuaaggucaaaauauaugaaaagcauaaaacagaucugaccaaguugaaagccgugaucaagaagcacuuuccaaauaacuacaaaaagguauucggguauaaccaggacaaugagucaaagaacaauuacagcggauauguugguguguguaagacgaaaaacaagaaacuggucauuaauaacagugugaaucaggaagauuuuuacaaguuccugaagcccauccucucugcgaaauccgagauaaaggaggugaacgacauucuggccgaaaucgagacuggcaauuuucuuccuaaacagaucagcaagucgaacgcagaaauuccauaucaacugaggaaaauggaguuggaaaagauccucucuaaugcugagaagcacuucuccuuucugaaacagaaggaugagaaaggguuaucacauagugaaaagauuauaaugcugcuaaccuucaaaauccccuacuacauuggaccuaucaacgacaaucacaaaaagagcuuuccagaucggugcugggucguuaaaaaggagaaauccccgucuggcaagacaacucccuggaacuucuuugaccauaucgauaaagaaaagaccgccgaggaguucauuacaagccguaccaauuucuguacguaucucauaggugaaucagugcugccuaagaacagucuuuuguacuccgaguauacuguacugaacgaaaucaauaaccuccagauuaucauugacgggaaaaauaucugcgauacaaagcugaaacaaaagauauacgaggaccuuuuuaaaaaguauaaaaagaucacccagaagcagauuagcacuuucaucaaacacgaaggaauuuguaacaagacagacgaggugaucauacugggcauugauaaagagugcaccucuucauugaagaguuacaucgaacucaaaaauauuuuuggcaagcaggucgacgagaucagcacgaagaacaugcuggaagagauaauccgcugggcuaccauuuaugaugaaggggagggaaaaacaaucuuaaagacuaaaauuaaggccgaguacgguaaauacuguuccgacgaacaaaucaagaagauacugaaucuaaaauucucuggcugggggagacucucgaggaaguuucuggagaccgugacaagcgaaaugccaggauucuccgagcccguuaacauuaucacugcaaugcgggaaacccagaauaaccuuauggaguugcugucaagugaguuuaaauucacagaaaauaucaagaaaauuaacucuggcuuugaggaugccgaaaagcaguucagcuaugacggucucgugaagccucuguuuuuauccccaucagucaaaaagaugcuguggcagacccuuaaauuggugaaggagaucagccacauuacucaagcucccccgaaaaagauauucaucgagauggcgaagggggcagaacucgagccugcccgaacgaaaacacgccugaagauucuacaggaucuguacucuuccugcaaaaaugacgcugaugccuuuaguagcgaaauccaguaucucucuggcaagauugagaacgaagacaaucugagacuuagguccgauaaauuguaccuguauuacacccaguuaggaaaguguauguauugcggcaaacccaucgagauagggcauguauucgacacuucaaacuacgauaucgaccacauuuacccacaaaguaagaucaaggacgauagcauuucgaaccggguucucgugugcuccucuuguaauaaaaacaaggaggacaaauauccucuaaagagcgaaauccagucaaaacagcgcggauucuggaauuuucuucagagaaacaauuucauaagucuggagaaguugaacaggcucacccguacaacccccauuuccgaugacgaaacugcaaaguuuaucgcccggcaacuggucgagacacgacaggcuacgaaaguggccgcaaagguccuagaaaagauguucccagagaccaagaucguguacucuaaagcggagacuguuagcauguuuagaaauaaguucgauauuauaaagugcagggaaaucaacgacuuucaucacgcucaugaugccuaucugaauauugugguagguaacgucuacaauacaaaauucaccaacaaucccuggaacuuuaucaaggagaaacgcgacaauccuaagauugcagauacauauaacuacuauaaaguguucgacuacgauguuaagcggaacaauaucacugccugggaaaagggcaaaaccauaaucacggugaaggacaugcucaaaagaaacaccccaauuuacacaaggcaggcugccuguaagaaaggggagcuguuuaaucaaacuaucaugaagaaaggacuuggccagcacccguugaagaaggaaggucccuucuccaacauuucaaaauaugggggcuacaauaaggucagcgcagcuuauuacacccugaucgaguaugaggaaaaagugaacaagauacgcaguuuagagacaauuccucucuaccugguaaaagacauccagaaggaucaggacgugcuuaagucuuaucugacugaucuacucggcaaaaaggaaaucaaaauucugguuccaaagaucaaaauaaauuccuugcugaagauuaacggauuccccugccacaucaccgggaagacgggagacagcuuugucuuacgaccugccgugcaauucuguugcucgaaugaugaggugcucuacuuuaaaaagauuauccgguucaacgagauacguucacagagagagaaaauggguaagacaauuucuccauacgaagaccugaguuuuagguccuauaucaaagaaaaucuuuguaagaagaccaaagcggaugagaucggcgaaaaggaguucuacgaccuguugcagaaaaagaaccucgagauuuaugauaugcugcuaacuaaacauaaggacacaaucuacaauaaacgccccaacagcaccacucuggggaugcuuaccaagggacgguaugaauuuauuaaucucaagccgaaagaucagauaaucgucaugcuggagauuuugaagcuguucugcacaacgagagaagccaucgacuuaggccucaucaaagguaagccugcugcagggguugccacccugggcaaaaagauuucuaaccuugauaauuguauacugaucuaccaaagcauuacuggaaucuuugagaagaggauugacuugcucaaaguguga

SEQ ID NO: 3274 - RNA, 4188 nt, Artificial Sequence
  Cas9 variant
augaagaaagagaucaaggacuacuuccugggccucgauguggggaccggaagcgucgguugggccguuacagacacugauuauaaacuucugaaggcuaacagaaaagacuuguggggcaugaggugcuuugaaacggcagagaccgccgaagugcggcgcuuacaccgaggggcgcguagaaggauugagcggcgcaagaagagaauaaaacugcuacaggaacucuucucccaagagaucgcuaagauugaugagggauuuuuccagaggaugaaagaaucuccccuguacgccgaggacaagacaauccuucaggaaaauacucuguuuaacgauaaagacuucaccgauaagacauaucauaaggcauacccuaccauuaaucacuugaucaaagccuggauagagaacaagguaaaaccagacccgcggcuccuguaucuggcuugucauaauaucauuaagaaacgcggccacuuucucuucgagggugauuuugacucagaaaaccaguucgauacaaguauccaagcauuauuugaguaccugcgagaagacauggagguggacauugaugccgacagccagaaggucaaagaaauccuuaaggauuccucuuugaaaaauucggagaaacagucaagacugaacaagaugcuagggcucaaacccagcgacaagcagaaaaaggcuauaacuaaucugauuaguggaaacaagaucaauuucgccgaucuuuaugacaacccugaucugaaagacgcggagaaaaauuccauuucuuuuagcaaagaugacuucgaugcauuguccgacgaccucgccucaauccugggcgauaguuucgaauuacugcucaaggcuaaagccguguacaacugcagcguucuuucuaaggugaucggcgacgagcaauaccuguccuuugcaaaggucaaaauuuaugaaaagcauaaaaccgauuugacgaagcuaaagaaugugauaaagaagcacuucccaaaagacuacaagaaaguauuuggguauaacaagaacgagaaaaauaacaauaacuacucaggauauguugguguguguaagacuaaaagcaagaagcugaucauuaauaacagugucaaucaggaagauuucuacaaauuucucaagaccauccugucugcuaaauccgagauaaaggaggugaacgacauucuuacagaaaucgagacuggcaccuuccugcccaaacagaucagcaagucgaaugccgaaauuccuuaucaguugaggaagauggagcucgaaaagauccugucuaacgcggagaagcacuuuuccuucuuaaaacaaaaggaugagaaagggcugucacauagugaaaagauuauaaugcuacucacauuuaagaucccauacuacauuggacccaucaaugacaaccacaaaaagagcuucccugaucggugcuggguggucaaaaaggagaaauccccaucuggcaagaccacgccguggaacuuuuucgaccauaucgauaaggaaaagacugccgaggaguuuauuacaagccguaccaauuucuguacuuaucugauaggugaaucaguucuucccaagaauaguuugcuguacuccgaguauacagugcucaacgaaaucaacaaucugcagauuaucauugacgggaaaaacaucugcgauaccaaacuuaaacagaagauauacgaggaacuguucaaaaaguauaagaaaaucacgcaaaagcagauuagcaccuuuaucaaacacgagggaauuuguaauaagacagacgagguaaucauauugggcauugacaaagaaugcacuucuucacucaagaguuacaucgagcugaagaacauuuucggcaaacagguggaugaaaucagcaccaagaauauguuagaggaaauaauccgcugggcaacaauuuaugacgagggggagggaaaaacuauccugaagaccaaaauuaaggcugaauacgguaaguacuguuccgaugagcagaucaaaaagauacuaaaccucaaauuuucuggcugggggagacugucgaggaaguuccuugaaacagucaccagcgagaugccuggauuuuccgaaccagugaauauuaucacugccaugcgggagacgcaaaacaauuugauggagcugcucucaagugaguucaaauuuacagaaaacaucaagaagauuaauucuggcuucgaagacguugagaaacaguuuagcuaugauggucuggugaagcccuuauuccuguccccuucagucaaaaagaugcuuuggcagaccuugaaacucgugaaggagaucagccacauuacucaggcuccacccaagaaaauauuuaucgaaauggccaagggggcagagcuggacccgguacgaaccaaaacacgccuaaagauucugcaagaucucuacaacaauugcaaaaacgacgccgaugcuuucucuuccgaaaucaaggaccugaguggcaaaauugagaaugaagauaaccuuagauugaggagcgacaagcuguauuuauacuauacccagcucggaaaguguauguacugcggcaaaccuaucgagauagggcauguuuuugauacuucuaacuaugacaucgaccacauuuacccccaguccaagaucaaagaugacucaauuaguaaucgggugcuggucugcagcucguguaacaagaauaaagaggauaaguacccacuuaaggcggaaauccaguccaaacaacgcggauucuggaacuuccugcagagaaauaacuuuauaucuuuggagaaguucaauaggcucacacgugcaacgccuauuagcgacgaugaaaccgccaaauuuaucgcucggcagcugguggagacucgacaggccacaaaggucgcagccagagugcuagagaaaauguuccccgaaaccaagaucguuuauucaaaggcugagacagugaguauguuuaggaacaaauucgacauuguaaagugccgcgaaauaaaugauuuucaucacgcccaugacgcauaccugaacaucgucguggguaauguuuauaacacuaaauucaccaauaaccucuggaauuuuauuaaggagaaacgggauaacccaaagaucgcggacacguacaacuauuacaagguguucgauuaugacgucaaaagaaauaacauuaccgcuugggaaaagggcaaaacaaucauaacugugaaggacaugcugaaaaggaauacccccaucuacacacgccaagccgcauguaagaaagggggacuuuuugaucagacuauuaugaagaagggcuugggucagcacccucugaaaaaggaggggccauucuccaacaucucuaaauacggcggauauaauaagguaagcgccgcuuacuauaccuuaauugaauacgaggagaaaggcaacaagauccgaucccucgaaacgauaccgcuguaucuugugaaggacauucaaaaagaucaggacguucugaagucauaccuaacagaucuccuggggaaaaaggaguucaaaaucuugguccccaagaucaagauuaauagccuguuaaaaaucaacggauuuccuugccacauaaccgguaagacuaaugacaguuuccuccugcggccagccgugcaguuuuguugcucuaacgaugaagugcuuuauuucaaaaagauuauccguuuuuccgagauuagaagccagagggagaaaaucggcaagacaauaucgcccuacgaagaccugucauuccgcucuuacauuaaggagaauuuguguaaaaagaccaaaaacgaugaaaucggggagaaggaauuuuaugaccuccugcagaaaaagaaucuagagaucuacgauaugcugcuuacuaaacauaaggacaccauuuauaagaaacggccuaacagugcaacaaucgauauucucgucaagggaaaagagaaguucaaaucccugauaaucgaaaaucaauuugagguuauuuuggaaauccugaaguuauucagcgcuacgagaaacgugucugaccuccagcacaucggcgguagcaaguacuccgggguggccaaaauuggcaauaagauaucaagucuggacaacugcauccuuauuuaucagagcaucaccggaauuuuugagaaaaggaucgaucuguugaagguauga

SEQ ID NO: 3275 - RNA, 4191 nt, Artificial Sequence
  Cas9 variant
auggacagcuccaagcagggccugagaagguaccaccucgggcuugauaucggaaccaacucuauugguuggacagccauagacgaucauuucucacuguugcgggugaaaggcaagaaugcuaucgggguccgcacuuuuaaagagggagaaacggcagccgaccgacguggcuucagaaccgcgaggcggcgcuuaaguagaaggcgguggcgccugcaauuucuagaugaguucuuugcucccuaucucgccgaaguugacccuaacuuccuggcacgacuuaagcagagcgauauuuccgccaaagacccagcuaagaaucaggaguacauggguaagcuguuguuuccggaucaggaagcagccucugacgggaacggauaucccacacucauccaaaugagaaaagcuaugccugccgagaaggcggcagauuucccaguguuuaauauuuaccagcugagguaugcccugaugaacgagaaacggaaguucgaccuccgugaaaucuacuuagcuguacaccauauagugaaauaucgcggcaauuuucugaacaauacuucggucgauaaguucaaggccgaccagaucgacuuuaacaaaucauucgagacccuuaaugauuuguucagacaggugcaacccauugcaccuuuucagaucgaccugacaaagguugaugaacuaggcaaacuccugcuugacaccaagcagaaaaagcuggauaggcagaaagcuguggccaaguugcucccacugauugaggacgggacugauaaggagaucgucaaagcgcaccaacagacagcccgggaaauaagcaaguuaauucugggauacaaagcaaaggugggucucauccuucagaacaaucuggaccaaaccuuggauaugaguacggagaacuccgacgaucagcuaaugcagauugcugaagaacuggacgacuaccagauggaacucaucaaucaacugucucuucuguauagccagaucauguugaacgagauuguacccaacggcgagacuguuuccgccucaaugcucaaucgauacuauaaacaucgcugccagcugaaggaauuaaaggauuacggggcugcccaggacaaaaagaccagagagcaacuggaucaccuauaugcagaauacauaggacagaucccuaaagacaguaaguucgauuuuacaaaagaccucaagaagcugauggauaaaagcgaccuuggccagaagauuaaagaugagaucgaagccggugacuauuugccaaagcagaggacuucugcuaacggggugauaccgcaccaaaugcaucagcaggagcuggaucagauuaucgagaaucaaaaagaauacuaccccuggcucgcggagccuaacccagucgaaaagaauaucaagaacgcaaaauauaagcuggaccagcuuguguccuuccgggugcccuacuaugucggaccuaugauuacccuggccgaucagcaaaagacaucaaaggcuagcuuugccugggcaguucgcaaaaaggccggcaaaaucaccccauggaauuucuacgacaugauugacagagagaagagugcuaacaauuuuauaaagaggaugacgaacaaagauacuuauuugcucucugaagacgugcugcccgccuccagcuuacuguaccagaaguucacaguacuaaaugagcucaacaauauccgugugaacggccggaaacugcagccggcacuuaagcaggcgauuuauaccgauuuguuucaaaaacgaaagacugucaaucugaagacacucaccaacuuccuggcuauccacgagccuacguuaaccaaacccaagaucgaagggcugucgaacggaagaucuuuuaauuccucacuugguacauacauugacaugaguaaaauauugggcgauagccucgacgaucugaacuacagggacgauaucgagaagauuaucgaaugguccacuguguucgaggacucugagauuuaugggguuaaacuacaggaaauccaguggcugaccaaugagcagcgcgaaaagcucgugcggaagagauaccaaggauggggcaggcugagcaaaaaguugcuuacagguauaacugaugagaacgggcagcgcaucauugaccugaugugggauaccucaaagaauuuuaugcagaucguccaucagccaguguucgaggagcaaauugccgaguuaaaccagcagcuccugcaagacgcagacaaggccccucuugaaguaguugaugacauccuggcugaugccuauacaaguccccagaauaaaaaggcaauacgacagguggucaagguggucgcugacgugguuaaagccgugggcaacgcgccagccuccauuagcaucgaguucgcucggaaugaagaucguaacaaggaguugaaaaauucuagaaggcacucaauugaaaagcucuaccacgagaccgcagagaaacugguaaagcagacuaaccuacuggaggaacucggaaaugucaaagaccugaacgaucgcuauuaccuuuauuuuacgcaagccggccgggacauguacgaugggacacccaucaauauagacgaaaucaguacccauuacgagauugaucacaucuugccucagagcuuccugaaggacaacuccuuagacaacagagugcucguuaagaaaucugaaaaugcugccaagucggauagggugccagcaaaacuguauggagcgaagaugcgagccuuuuggaaacagcuuaaggagagccagcugauuuccaaccgcaaguaccuaaaucucacuaccgacccggagcaagucgauaaauaucagaugcaggguuucgugcaucggcagcugguagaaacaagacaaaucauaaaguuggcugccaacauuuuuggcucacuguaccccgacagugcagugaucgagaccagggcugaauuaacuaaacagcuccgugagaaguucucucuguauaaaguucgcgaugucaaugacuaccaccaugccguggaugcauaucuuacagccuuugcugggcacuaccuguaccagcgguauccuaaguugagaccaauguucguguacggagacuaugcgaagaucuacgccgaugaccucaaaaggcugcgaagcgucaaccuauuucacgaucuggagaaggaccaguauaauuccggcacggcaguuaaccccgaaaccaaagagaagauuguggauguggacuggcuuucagacuacguaagcaaaauccaacauuucaaguauaugcucauuucuaaggcugucuacacucagcacggucagcuguacggggccacaauauugccuguggcccaaguugauaaaaucuccgcuccaauuggcaucaaggacgauaaacccguggacauuuauggagcauacaccaaugaagucgccgcguauauggcuaucgugcggguuaacggcaagaaaccgaaguacaaggugguaagugucccugugcgcaugcugcagagauuaaaaauggccgagcagaaggggcaugaucaguauaugcaaacacuccacgacgugcugcuuaggaauuuuacuagccugaaaaagaaccggaaaaccggauugaaggaagcagucguuaaagauuucgacgugcucguaccaugugugcgauacaaucagcuggucauagauggugacacgaaguuuacccuaggcucugccacauaucagcacaacgcuaagcagcuggugcuuugcaaucauucccucgagacucuggcaaacaacuucgaguacguuagaaaacaccccgaugaagccgacgagcgcaugaucauguuguacgaugacauuuuagaccaagugaaucauuauuucacccuguacgauaagaacaaauuuagggaaaagcucaaugcggggcgugacaaauaucugaaacuuccuacauucucacaguuugagaacaauaagaaaacugcuaucggaaagagugaagccauuaucaacauacugcggggcuugcacgcaaaugccgcuauuaccaaccuaaaaugucugggugucagcacgcccuucgggcagcuccagucgccauccggcaucgagcugucugagaaugccaaacuuguguaccaaagcccuacaggauuauuuucaagagaaguucugcucaaagauuuguga

SEQ ID NO: 3276 - RNA, 4191 nt, Artificial Sequence
  Cas9 variant
auggccaaccugagaaauuacaagggcgacuauaacaucgggcucgauaugggaaccgguagcgugggcugggcugucacagacuccgaggggaaacuucugcacuucaagaaacagcccacuuggggaucuagguuguuugauucagcagaaacggccgcgagugcucggauuccucgcggccaacgacguagauacguuaggcggcgcuggagauuagaccugcuacagcagcuauuccaggaugaggugagcaaggccgacccagaauuuuucauaaggcugcggcaaucccgccuucugaaagaggaucgagaagagggucauagagacuauaaucacccguuguuuaacgauucugacuucaccgagacagauuacuauaauagguuucccacuaucuaccaucuccggaaguggcugauggaaaccgacgagaaggcagauauucgucugguauaucucgccgcucacaacaucgugaaacaucgcgggaauuucuuaagacaggaaaacacaucgcugucagcaaagaaugccaggccucuugacgcuuugcgggaguuucgaagcgcccuggucgacuggugcgcggagcuaggauacgaauguaacccagaugagaguggcgaaauuuccaaugagauccucucugugcuggaagaggagcacguugcaaacagcgacaaaaagaaacgcauauccucacuuaucggcguggccaugaaugaaggggcuaaggagaguaaggccugcaacgaugcacuggcuggagccauggucgguuugaaagcggaauuuaagaauguguuuggcgagauuagcgccgaacagaccucuaucuaccucuccaacgacgaggcaguagaugcucugagagaggggauucccgacgaaggauuagagcuguucggcaaacucuguucaguuuauagcgccuacgugcuucagggucuguugaguuaugcuccugggcaaacuaucucugucaacaugguggccaaguacgaaaaauauggaaaugaucuaaagacacugaaagcacucgugugcgaguacgccagggcugaauaugacuccuuuuuccggggcgaguucuaccgcgaucaggacggccacgagcugaacauauacaaugcgagcaaggcacagggguauaccagauacaaccuuggaacgucgaagaugucuuaugaagauuuugagaaagccgucaagaaacuguucgcugguacugccgcagaagaggacggcagguacuugcagaugaugaaggaguuuggggaacaacguuuccuccggcgacugaaaaccuccgacaauggaucaauuuauuaccaguuacaucuggaggaacuaacagccauccucaguaaccagggcaagcacuauccauuucugguugaggaugcugaaaagauuaaaagccuuguguccuucagaauccccuacuacguagguccuuugacugacaggaaugcccgcaaggauaaacaugggaagaaccgguuugcauggucugagagaaaaagcggcauggaggacgcggugaucaccccauggaauugggaugaagucauugacaggggaaagucagcugaggccuucauaacacgcaugaccggcauguguacguaucugcaaggggaagaugugcucccgaagugcagucugcuuuacgaggaauuuuguguucugaacgaguugaauggaucccgaugggguauggacggcgauaaagagcaccgguucgacgcagccgaucgugaagcuaucauugaggaacucuuuaagaaaaagaaaacugugaaguauaaggacgucgccaacuggcuggagagagaagcagggaggaugaaugugcacguaaugggaggccagggugagacaggguacgagagcaaauuaucuucauauuacuucuuucgccgggauaucuucgacguugaggaacuggacagagcugauuaucccaugauagaacagauuauccuauggaacacccucuucgaggacaggcgaauccugaaggagaaacuugaagaugccuacggcccuaagggaaauggccgcuuggacgaugaccagauuaaaaagaucugccggaaaagauuuacuggguggggaaggcugaguaagaaguuccucacagguauuaaaguggauaccgacuguggcccacguagcauaauggauguccugcgcgagggggaccccaacgcgggauuucggggcaagacgauggugaugauggaagucuuaagagaugagaaccuggguuuccaacagaaaguggacgaauuuaauaagaacuacuucgggcagaaaggcaaggcccuugagguuaaugaguugccuggauccccagcuaucaggcgaucucucaaccaggcaauucggaucguggaugaaaucgccaagauugcuggcaaagaccccgagucgauauuuaucgaaguaacccgcgacgaugagcuggacaagagagggaaaaggacaaagcggcgauaugaugcccuaaaagaagcacugacugucuucaagaaggaggacccggagauuugggcggaacuccaagccaccagcccuuccgaucuggacgagagacuuacauuguacuuuaugcagcgcggaaaaugccuguauucaggcgaacccaucgauauuaauaaguuaaguucuggugaguacgaaguggaccauaucauaccaaggagcuauaucaaagaugacucccucgagaacaaggcucugguuugucguaaauacaaucagucaaagacugaugccaugcuucuggacccuagcauucggagaaagaugaggucuuauugggacauguugcucgaugcaaaacugaucgggcccaagaaacaccgcaaccuacugcgagaccauauugaugagaaggcuaugaaaggauucguggccagacagcucgucgaaaccucccaaagugugaagcuggcaggcagccuuuugucuguacgguacccaaaugccaacaucgugcccguuaaggcuuccaugucacacgaccugagggaggcggccgguuuugucaagugccgcgaagcaaaugauuuccaucacgcucacgacgccuacuuagccugccguaugggccucuuuauacagaugagacauccuaagguguaugagaacccaauugcuaugacacgggugaugcagaaauacgcacagcaacagaguaaggaguucaauaggaaccaccgcgucccggggaccagcggauucaucguuaauucguuuauguccucuggcuucgauaaagaaacuggggagauuuuuaaggacacguggaacgccgaaacagagaucgaaggaauacgaaaagcgcugaacuauagacaguguuacaucagccggaugcccauggaggauaccggcgcuuucuggaaugccacuguguauucaccuagggacccaaagaugggucccaaacuugcacugccucucaaaaaggggcucgaucccaaaaaguacggaggcuuuaguucccaacaguucgccuauuucuucguguacgaggcucgcgacaaaaaggauaagcagguauuuagauucgcagaagucccaguguggcuggccucucagauugagagcgacaaaaucgcguuggaaagguacgcuaccggucuggccgaggcagaaaaguuaaaauuuguucggauugagcgugccaagauccucaaaaagcaacugauagagauugacggcgaucgcuucauccuuacagggaagaaagaaaugcgaaacggaagagagcuggcuuugucccagaaggaaacccucaaucugaucguggccggcgacgagaacgcaucacuagaugacagggggaaugcuagcgaugccgucuucgacgcgauugugcggcagggagaugaaaucggccugcgccuuuauaaacagcucaagauugccgagauagcagagagauacaggaguguuggugcugacgccaaagugggggcuguaaugucucuguuguccagcaucaacgcaucgucaaauauggucaaccugucuauggugggaggcaguaaguaugccgguaauuuacaaccgaacuacuccaaucuccugagcgauccugaaacuaacuuugugauuaucgaccagucugucacaggcauguucgagcggcgaacgagaauugggcuuuga

SEQ ID NO: 3277 - RNA, 4191 nt, Artificial Sequence
  Cas9 variant
augaccaagcccuacagcaucggccuggacauugggacaaacuccgugggaugggccgucauaacugaugacuauaaaguuccugcuaagaaaaugaaggugcucgguaauacgaacagagauuacaucaaaaagaaucuucugggcgcauuguuauucgacgggggagagaccgccgaaggcaggcggcugaagcgcacagcgcgacguagauauacuaggcggaaaaaccgccuaagauaccuccaggagauuuuugcugaagagaugaugcaaguagaugaaucuuucuuucagaggcuggacgauucauuccuuguggaggaggacaagcaggguaguaaauauccaaucuuugggacccugaaggaagagaaagaauaccacaagaaguucaaaacaauuuaucauuugcgggaggagcucgccaauagcaaggaaaaagcagaucugcgccuggucuaccucgccuuagcucacaugaucaaguuucgaggacauuuccuguacgagggcgaccuuaaagcagaaaacaccgaugugcaggccuuguuuaaggacuucguugaggaauaugauaaaacuauagaggagucccaccugucugaaaucacaguggacgcucuaucgauucucaccgagaaggucucaaagagcaguagacuggaaaaucuuaucgcccauuacccgacggagaaaaagaacacucuguuuggcaauuugauugcgcucucccugggguuacaagcaaacuucaaaaccaauuuucagcugucugaagacgccaagcuccaguucagcaaagauacauaugaggaggaccuugaaggacuguugggugaggugggcgaugaauacgcugaccuauucguauccgccaagaaccuguaugaugcaauccuccugucagggauacuuacuguugacgauaauaguaccaaggcuccccugagcgccucuauggugaaaagguacaaggagcacaaagaagaguuggcggccuuuaagcgguucauuaaagagaagcucccuaagaaauaugaagagaucuuuaaggacgauaccaaaaacggauacgcaggcuacgucggugcugacaagaaacugcguaagcgcuccgggaaguuagccacagaagaggaguucuauaaauacgugaagggcauucugaauaaaguggaaggagcugauuauuuucuagacaagaucgacagagaggauuuccucaggaaacagcggacguuugacaacggcucaaucccacaccaaauucaucugcaggaaaugcacgccauacuucgacgccagggggagcauuaccccuucuugaaggaaaaccaggauaaaaucgagaagauucugacuuuuagaaucccuuauuacgucggaccacucgcaaggaaggguagccgguucgccugggcugaguauaaagcggacgaaaagauaacacccuggaauuuugaugacauucuggauaaagagaagagugcagaaaaauucaucacccgcaugacucuuaacgaccuguacuugccugaggaaaagguucucccaaagcacucuccgcuguacgagacauuuaccguguauaaugaguuaacgaaaguaaaguacgugaacgaacaaggcgaggccaaauucuucgauaccaauaugaagcaggaaaucuuugaccacgucuucaaagagaacagaaaggugacaaaggauaaacugcuaaauuaucucaacaaggaauuugaggaguucaggauuguuaaucugacugggcuugacaaagaaaacaaggcuuuuaaugccuccuugggaaccuaccaugaucugcguaaaauccucgacaagagcuuccuggacgauaaggugaacgagaaaauuauagaagacaucauucagacauuaacucuguuugaggaucgggagaugauccgacaaagacuucagaaguauucggacaucuucaccacacagcaguugaaagaacucgagaggcgccacuacaccggcuggggucggcugucuuauaagcuaauuaaugggauaagaaacaaagaaaauaagaaaacuauccuggauuaccucauugacgauggcuacgcaaacaggaacuuuaugcaacugaucaaugacgaugcccuuuccuucaaggaggaaauugcucgcgcccagaucauaggagacgucgaugacaucgcaaacgugguacaugauuugcccggcagcccugcgauuaagaaagggauccugcagaguguuaagauuguggacgaguuagucaaagugaugggacacaauccaacgaacaucauaauugagauggcucgagaaaaucagacaaccgacaagggucggcguaacagccaacagagacucaaacugcuucaggauucccugaagaauuuggacaaccccgucaauaucaagaacguggagaaucagcaacuccagaacgauaggcuguuucuauauuacauucagaauggcaaagacauguauacuggggaaacccuggauaucaacaaucucucucaguacgacauagaucauaucauuccucaagccuucaucaaggacaacagccuggauaaccgcguucuuacacggucagacaaaaauagaggaaagagugaugacgugccauccauugagguaguccacgaaaugaaaucauuuuggucuaaguugcugucagugaaguuaaucacccagaggaaauucgacaaccucacuaaggcagagcgaggcggucugacagagaaugauaaagccggguucauaaagcgccagcuuguugaaacgcggcaaauuaccaaacacguggcucagguccuggacgccagauuuaacgcaaagcaugaugagaauaagaaagugaucagggacguaaagaucauuacucuaaaaaguaaccucgugagccaguuccguaaggauuuuaaauucuauaagguucgcgaaaucaaugacuaccaccaugcucacgaugccuaucugaacgcggucauuggcacagccuugcugaagaaauaccccaaguuagcuuccgaguuuguguacggagaguucaaaaaguaugacgugcggaaauuuauagcaaagucugauaaagaaaucggcaaggccaccgcuaaguacuucuuuuauucgaaucucaugaacuucuuuaaaaaggaggucaaauucgccgacgggacaguuguggaaagaccggauauugagacuagcgaagacggagagaucgcauggaauaagcagaccgauuucaaaauugugaggaagguacuguccuacccucaagucaacaucgugaagaaaacggagguucagacccacggucuugaccgaggcaagccccgggggcuguuuaaugcgaacccaucaccuaaacccaagccagacaguucugaaaauuuggugggaauaaaacgcaaccucgaucccaagaaguauggcgguuacgccgggaucagcaacuccuaugcuguccuggugaaagccauuaucgagaagggcguuaaaaagaaagaaacaauggugcuagaguuccagggaauuucaauccuggacagaauaacuuuugaaaaggauaagagggcauuccuucucggcaaaggguacaaggacauuaaaaagaucaucgagcugccuaaauacagcuuguuugagcugaaggauggaucucggcgaauguuagcuuccauucucaguaccaauaacaaaagaggcgaaauacauaaggguaaugagcuguucguaccacagaaguuuacaacucuucuguaucacgccaaacgcaucaacaauccgauuaacaaggaccauaucgaauacgucaaaaagcacagggaugacuucaaagaguugcucaauuaugugcuggaauuuaacgagaaguacgugggggcaaccaagaauggagagcgucuaaaagaagccgucgcugauuucgacagcaagucuaacgaggaaauuugcacguccuuucugggcgcgguuaauaguaaaaacgccggucuuuucgagcucacaucacugggcagcgcaucggauuuugaguucuugggggugaagaucccccgguauagagacuacaccccuuccucuuuacugaaagauagcauacucauccaucaaucaauuacuggacuguaugaaacaaggaucgaccuuaguaagcugggcgaggacuga

SEQ ID NO: 3278 - RNA, 4191 nt, Artificial Sequence
  Cas9 variant
augaagagagugaacgaggacuacauccugggccucgauauugggaccaauagcugcggaugggccgucacagacaaaaagaacaaucuucugaaauugagggguaagacugcuauaggcucccacuuauucgaagaggggcauacggcagccgaucggcgcggauuucgaaccacacguagaaggcugaaacggcgcaaguggagacuaaggcuccuggaagagaucuucgcggaacccauggcuaagguugacccuggcuuuuucgugcggcuucaccagucuuggguaucaccacuggauaaagaccgcaagaaauauaacgccauuguguuuccgacugcaaaggaggaucaagccuucuacaaacauuaugcuaccaucuaccacuugcgagacgagcucaugacacaggauagacaguuugaccugagggaaauuuuccuggcaauccaucacauagucaaguaucgggguaauuuucuccaggauacccccgugaaggacuucgaggccaguaaaaucgaaguugggccuauuuuaagccacaucaacaaugcuuuugccgagaagauuguggaggaucaagacccaaucgaacugaacgucgcgaaugcagccgacauagaggaugugauucguggaaaagacgcugaaaagacuguauacaaacuugauaagguuaaaaagaucgccaaguugcugacagacuccaccgcaaaagaggaaaagaacguggcuaaacagauugccaaugcgaucaugggcuauaagacgcaguucgagacuauccuagauaaagagauugacaagucugauaaggcccagugggaauuuaaacucucggacgcagaugcugacgauaagcuggacgcccuucugcccgacuuggaugagaccgaccaaacagucguggcugaaauagagaaacucuucucagccaucacucugagcaccauuguggaugaaaacaagaguuuaucccagucuauggucgagaaauacaagaagcauaaaaaggacuacaaaaagcugaaaaaguauaucaauacacuccaggaucagaccaaggcaaagaaacuucuguuggccuacgaccuauauguuaacaaucgccacggcagacugcucgaggcuaaaaagacguucgaagauaaaaagaaaaagaaggcgcugacuaaagacgaguuuuacaagauagugaaagauaaccuugacgauagcgaccuggcacaugaaauucaacaggagaucgccgcugauaacuucaugccuaagcagaggacaaauuccaacgggguaaucccauuucaauugcaccagauugaacucgacaaaaucauugccaaucagggaaaguauuaccccuuccuggcagccgagaacccuguggaggaccaccggaagcaggcuccauauaaauuagaugaacugguccgauuucgcgugccguacuacguuggucccaugauaaccgccgacgagcaagaaaagacuucaggcaaaaguuucgcauggauggugagaaaggaggaugggcagaucacaccuuggaauuuugagcagaaagucgacaggcaggaaagcgcgaacaaguucauuaagcggaugaccaucaaagauacguaucuacucucugaggacgugcugccagcuaauucccuuuuguaccaacgcuuugaaguacugaacgagcucaauaacaucagaauuaauggaucaaggauaagcguugaucugaagcagcagaucuucaacgaccuuuuugaagagaaaaagaccgugacagagaaaagucugacuucuuauuugaagcagaaucuccaucugcccaccgucgaaauuaagggcuuagccgauccuacaaaauucaacuccagccuggcaucguacuaucaccuaaagucucuccauguguuugacaaagagcuggccgauccacaauaccagaaggacuucgaaaagaucauugaguauuccucaaucuucgaagauaagaaaauauuucaggacaaacuucacgcugaguucaagugguugacucccgagcaguuuaaagccaucaguaccuggcgucugcaagguugggggcggcucagccgaaagcuguuagucgaacugcaugacacaaauggacagaacauuauggagcagcuuugggauucccagaaaaacuucaugcagaucgugaccgaaccggacuuuaaggaugcaauugcuaaagagaaucagaacguuacuagagccaauggcguggaagagaucuuggcggacgccuacacgucuccugcuaacaagaaggcaauaaggcagguagucaaagugguugccgauguggucaaggcugccggcgggaaaaagcccgcacaauucgcgauugaguuuacacgcgacccagauaaaaauccucagcucagccacauccggggaaccaagcugcuaaaggccuaccaggaaacugcuggugagcugguggaccagaaacucaccgauucacugaaggaagccaugacaaguagaaaacuuuugaaggacaaauauuuccuguacuuuaugcaagcaggcagggaugcuuauaccgggcagaagauuaacaucgacgagguauccacuaauuaccagauagaccacaucuuaccccagagcuucauuaaggaugacucuuuugauaaccgcgugcucacagccacgccacugaaugcagagaaaucagacgauguucccuauaagcgauucgccaacaauuacgucagugacaugaaaaugaccgugggagaaauguggaagcauuggcaaaaagcuggcaucauuaacaagcacaaacuugguaaucuguugcucgauccugaccggcugaacaaauuucaaaagagcggguucaucaaucgucagcuaguggagacuucccaaauaauuaaacuggucucuguuauccuccagaacaaguauccagaugcggaaaucauuacagugaaagccggcgacaacucggcacugagacagaggcuuaauuuguacaagagccgcgaugugaacgacuaccaucacgcuaucgaugccuaucuguccauuauauguggaaauuucuuauaccagguauauccgaaauaccggcccuauuuugucuacggcaaguauaagaaauucucacaagacccugaccuccagaaggaggugaucaaacacuuuaagggguucaccuuuauguggccacugcuucagaaagauaacagugaaagaaaggcccccgagaagauuaaagagaauaacucugacaggaucguuuucuacaagcauccugauauuuuugacaaacugcgaaaggcuuacaauuauaaauacaugcuagugagccgcgaaacaacuaccgagaacuccggacucuucgaugucacgaucuauccacggggugaaagagaccuggcaaagaccaggaaguugauacccaaaucaaauggccuggauccgaagaucuacgggggauauagcggcaacacagacgccuacauggugauuguuaaaaucgauaaggguaaagagucuauuuauaaggugaucgggguaccuaugcgugcguuagcuucccucaaucgcgccaagaaacagggcaacuacaaggaggaacugcaccaaguccuugagccacagauaauguuugacaaaaauggaaagcccaaacggagugugaagggcuucagaauuaucaaagaucaugugccuuuuaagcaggucguucuggacggggauaagaaauucauguugaacagcucuacuuacgaaaucaaugcaaagcagcucacccugacacccgagacuaugaggauugugaccgacaaccuaaagaagggagaagaccaagaucagcugcuuguaaaagccuaugacgagauacuccagaagguggaucaguaccugccauuguucgacgucaacaaguuucgaaauucccugcacuuaggucgggcuaaauuccucgaucuggcagugaacgacaagaaaaucacgcuuacaaauauucugaacggcuugcaugauaaucucguuaccccugaccugaagaacaucgggauuaaaacuccccuaggaaagcugcaagugccaucaggcaucguccuuaguagcgaagccauacucaucuuucagucgccgacaggucuguucgagaagcgcgugagaauugcggauuuguga

SEQ ID NO: 3279 - RNA, 4194 nt, Artificial Sequence
  Cas9 variant
augaaggacuacaacaucggccuggauauugggaccagcuccauaggauucgccgcuaucgacgaugacaauaaccucauuagagugaaagguaagaaugucaucggcucuaggcuuuuugcagaggggaaaacagccgcggaacggcgcggauuccgaacugcucguagaagguauaaccggcgcaaguggagacugaaauuguuagaugagauuuucuacgaagagaucauacacaucgaccccgaguucuuuaauaggcugaagcagucaaguauuagcccuaaggaugaguccaaaaaguauuucggcucucuacucuuuccagacaaaacggauucggccuacuaucaugacgguaaccaaaccaucuaccaccuucggaaucgccuuguucaucagaaggagaaagcagauauucgagaaaucuaucuggccuugagacacauagugaaguacagggggaacuuccucgacucaacaccgguaagcaguuuugaggcugauaaucugaagcuggacgaacucgugcccgucauuaacgacauguacgagaauaucgauauugacuucuccaucaacguggauaauaucucugagauugaaaaaguuuuacuggacaaccaucuuaagagcgcagauaaacaggaccgguugaaggagcugcuauaugauaauccugaauacccagacgauaaagugaagcagaaagagauauccaaguuucguaaggaccucgauaaagaaaucauuaaggucaucgugggauauaaauucaacgccuacaagauaguaaacuauauucccgacgacggcucaaaauuuaguuucagcuucucugaugaguccucagacgauaagcuggacgaucuuagcgagguucuggacgauagucaaauggaaaucuugaauacucucaaggugaucuacucucgcgucagacugaaccagauuaucccuaauggcaugggguuauccgagagcaugguggcuaaauauaacaggcaccacgaacagcuggaggaccucaaggaacuucuggauguguugccaaaugacgagaaacggucgauugaguacgccuacaccgcguauauaggaaacgucgauaagcagaaauacaauaacaaucuaguugcaucucugaaggaccuccccaucaagggugauauuaacaaaaagauccaagccguguuugaauaugcuaaaggccauaucuccucacaggaccuguacgacguaauuaagacaauaaucauugauaaauaucuugaggacgaaaguuucgaguaccacgaucugguggaacgaaucagcaaugacauugauaacaaggacuauuugcucaagcagcgcuccucucagaaugggaacaucccucaucaaguccaccagauggagauggauaaaauaaucgccaaucagagccaauacuacccauuucugggaguguuaaacccgaacgagucaagaaggcacauugcaaaguauaaaaucagugaacugguuuccuuccgggugcccuacuaugucggcccucuaauuaccccagaggaacaggagaagacuagcgguaaacauuuugcuuggaugaagcgcaaagaggccgggaagaucacacccuggaauuucgaagagaagguggacaaagaagcgaccgccgcaaaguuuauaaaaagacucacgguaaaggauacuuaccugcuuaacgaggacguuuugccugauaauucucugcucuaucagcaguucaaagugcugaacgaacuuaauauugucaaggugaacaauaagaggcugaccuugucagagaaacaaggagucuacaacgaccucuuuaagaauacaaaaaguaucacugugaagcgucugaaaaacuauuuaauuagcaauuacaagcaccuggagaacaucgaaauaaccggccuauccgauggcgacaaguucaauaacucucucgggacauacaaugacuuuaaaaagaucuucggagcucggauugaugacguuaacuauucggccgauuuugagaacaucauugaauggagcaccguguucgaggaccgauccauccugaaagaaaagcuggagaaagauauagacuggauuacgccagaggaaaucaaggcuguagucgccaagagauacucagguuggggcagguugagugcaaaacugcucacugagcuguuagaugacgaugggcagcgcaucauugacauccuguggaaugauucuauuacauucauggaagccgugagcaagcccgagauaaaagcucagauccagaacauuaaucgggacuuuaucaaggcgaccgacauugaaacuguucuugaugaggcauauacauccccgcaaaacaaaaaggccaucagagagguguacaaauuggucaaggacauacagaaggcuaugggaggcaaagccccuucaagcaucucuauugaauuuaccaggucccccgaggauaaugguagugugacgaagacccgcuauaacaauaugcagaacaaauacaaggaacucgggaaagagcugagcgacgaucuaucugcacagcugaaggaguauaagggccgaauggaccaagauaaauuuuaccucuacuucaugcagaugggaaaggaccuguaugauggcuccacaaucaaucuugacgauuugaacucauaccagauugaccauaucguaccacagaguuuuuauaaagaugacagcauagacaaucgggugcugacucacuacaccaacaaucaaaagaaagggaaccauacaccuuuaaauggacucaacauugaugcccagacucagaaccuguggaagcaccuuaauaagcuggguuugaucucgaaaaagaaacuccaaaaccugugcuucaaggacaucaaucagcuauccaaauauaccaagcacggcuuuguucguagacagcuggucgaaacaucucaggugauuaagcucguggcuaacauacugagcgaugaguucgccaaugacgggaccaaaaucauugaagucaaggcaaaaaugaacucacuuaugagggauacuuuuaauuuguacaagguucgccaacugaacgacuaucaucacgcgguggaugcuuacuuaacgacauucgugggaaaauaccucuauaagcgguaccccaagcugagaaguauguuuguauauggcgacuucaaaaaguuuuccgccgaggaugaccuuaaagauaucaagaccuucaauuuccugcaugacauuacuaacccaaaagaaucuaauaaggagaaaaucuacgaugaaaagagcggugaacuaauacucgacaggaagcacgcaaucgagaccauuaaaaagaucuaucaguacaaauuuaugcugauuguccgagaaguguccacaaagucagggcaguuguucaaacagaccaucuauagcgccaagaagacuaacggccugaaaagugcuauacccguuaagucuaauuuagagccuuccauuuacggauaccgcagcggcaacguggaccaccauauggucaucgugaaaaucaagaaagggacaaaguauucguuuaagguuauuggaaucucagcccgggcaauacaagaacucgagauugcuaaaaagaucgguaauuacagagauaaacuguaugaggugguaucugacaggcuuagucaguccaugaaaagcgucgaaucuuuccguauuauccuggauaacauaauguacggccaguugauuguggacgggaaugauaaguuuacgcucggaagcgccgacuaucgcaagaacucccggcagcuggugcuauguaccaacucacugaagauccuuaaagaugaggacuacaugaauagacucagugauauccaaaggagcaagcugaugguccagguuuaugacgaaauuaucaaaauuaugaagaacaaauacucuuuguucauauccaauacugagaagcuguuagaaaaacgagauaucuuuugcggccucucauucgacgagcagaagauugugaucuggaagaucauuauagaccugcacaacgguccauuuacaaaaauccaagagcuugggauuaauaacaagaugggcaccuuccagacaaaacauggaaucauucugacugaaaaugcgaucguaauauaccagaguccgagcggcuuguuugagcggaaggugcgccucaaagaucuguga

SEQ ID NO: 3280 - RNA, 4194 nt, Artificial Sequence
  Cas9 variant
augaagaaagugcugggccucgaccuugggaccaacagcaucggaugggcccuggucaaugaggcuacaaaggaagagaaaaaggaagguaaauccucugagauuauaaaguugggcguuagagugaaccccuuaacuguagaugaaaagacgaauuucgagaaagggaggccucugucaaccaacgcagaccggacacuaaagcgcagugcccgacguaaucuccagagauacaaacugaggcggcgcaaccuuaucgagauucugaucaagaauggauuuauuacuaaagauaccccauugacagaaaccggcaaggacacuacacaccaaacccucaagcugagagcgaaaagcgcuaaggagaaaguggaucugaaggacuucgccaaaauccucuuaacgauaaacaagaaaagggguuauaaguccucucggaaggucaauucggaugaagacgggcuggcaaucgauggaauggccguggcuaaacaucuuuacgagcagaacuugacuccgggccaguauguucugaaucuacuccagaagaacaaaaaguacgugcccgacuuuuaucgcucagaucugcaagaggaauuuaaaaauauuuggaacaaucagaagaccuacuauuuugacauccuuacagauacucuguucgaggaauugaaggacaaaaacaagagccagaccugggcaauuugcaaaaagccuuuugacaucgccggcauaaaacagauugggaaggcuagugauaagcgacucgagagauacaaauggaggacagaaggacugacccaaaaguuaaaccuggaguaccucgccaucgcgcuucaggagauuaauaacgacaucaauaaauccucugguuaucugggcgcaaucagcgaucgguccaaggaauuguucuuuaacaaagagacggucggggaaaaucuauaccgucagcuggugaagacuccacacacaucacuccgcaaccagguauucuauagacaagacuaccuggaugaguuugaaaccauuugggagacucaggccaaguucuauccccagcuuacacauacccugaaagaggaaauaagggacguuaucauuuucuaccaacggaaguugaaaagucaaaagagccucaucucuuucugucaguucgaguccugggaacagacguauauagagaaagaaaccggaaagucaaaaacacgaacugugggccgcaaggucauuccuaagagcaguccacuguuucaggaguucaaaaucuggcagaauuuaaacucucuggaguuuagaaauuccgaugaaggugagaucauugaguucaucaagcuagacgaagauauuaggcagaccguguuugaggaacucaaccugcgggggaaucuuaaacccaacgacguguugaagauacugggaaauuacaucagccucggcaaagucucgcaguggaagugcaacuucgaggaaauugagggcaaucgcacaaacgcugcccuguacaacguuuaucaaaucaucgcagaaaaugagggguacggauuugauugggcuaagaaaacugccucugagauuaacaaggaacuuaaaaauauauucccucagcuggguaucgacgcguccauuuuggacuuugauuucacccaggccaacuuugacaagcagacaucauaucaacucuggcaccuguuauacagugcagaggaagauuucaaaaucagcgaggaagacaaggugcuguauggcaauuccucuguaagccuaaagaaaaagcuccaucagaaauacggguuuaagccagaguauaccaaacugcuuacuaacauuucauugcagccggauuacggaaaucugagugcuaaggccaucuguaacauacuccccuaccugaaggagaauaacguguauuccgaggcuugcgacuuaacgggcuacaaucacagcaacuuccugacagccgaagaacaggcaaaaagaccucuuaagccaaucuuggagcuccugaaaaagaacucucuaaggaaucccgucguggagaaaauucugaaucaaaugguuaacguggucaaccaggugaucgaaaccuaugguaagccugaugagauucguaucgaacucacucgggagcugaaaaagucagccaaggaacgagcuaauaugaccaaaaguauagcggacgcaacaagaaggaacgaugacuaccgcaagaccauuaucaaagaguucgggauuccaaaucccacuaagagcgauguaguucgguauagacuuuggcaggaguuggccuccaggggcuacaaagacaucuuuacagauacggaaauaaagccgcaagagcuguucucuaacaagaucgacauugaacacaucauuccuaaggcuuuacucuuugacgauucguucagcaauaagacccuggccuuuaaaaaggacaaccuuaaaaaggcaaaucgcacugccuaugauuucaucgcuaacgacuacgcccccaaucuggagaacuacauagaacgaguggaguccuugcauaaggaucggaaaauuacacgugcaaagagaaauaaacuccugaugcuacagucaaagcugccagacggauuuaucgagagggaucuccgcaacagucaguauaucaccaaagaagcgaagaagaugcuguacgaggucugucggacaguggucucuacuagcggcuccauuaccgacaaacuuagagaagauugggacuugaucaaugugaugaaggagcugaacuucccuaaauauaaggcuuuagggcucacggagaaaauugaaagguacgauauaggagccgagaagaugaaggaaguugagaucauugaagacuggaauaaacgaaacgaucaccgccaucacgcaaucgacgcccugaccguggcuuuuucaacacacagccauauucaguaucuuaaccaccugaaugcccggagagacgagggucauaagaaacacgcagcuaucauagccaucgaaucuacuauuaccgagaaggagggcaacaaaaagaggcguuucaucgcgccccuaccaaauuuucgccuccaagccaaagaacauauugaguccauccugguaaguuucaagaacaagaauaaagucgugacaaacaauauaaacaagacuaaacggauuaagaaagauaaguuuaauaccaagguucaguugacgcccagagggcagcugcacaaagaaacaaucuacggaaagaucaaacagccuuuagagaagcacauuaaacucaacaagagcuucacccuggagcaagcuaaacuuauaaucgacaaaaggcagcgagaaaaggugcugaaucauuuggagaaauaugcacacaacucugauauugccuucaauuccaagacucucaaaaagaacccacugcuaaucucagacgaaccgcugaaggagguccuuugcuuugaagagguguucacaauucggaaagauaucaguuacgacaauuuuaagaacgagaaacagcucgauaagguaauagacgaaaaagugaagcaggcucugaaagagcgcaucaaucaauacaacggcgauuucagagaagccuuuagcgacauugagaggaaccccaucugguugaauaaggcaaaggguauuuguguuaaacgggcgaccaucaagggggucucgaacgccgaaccucugcauacugcuaaaaaucacuuaggcgaggaggugcucaccgaaaacaaggagcagauaccaguggauuaugucuccacaggaaauaaccaccauguugccauuuacgaagacgaggacggcaaucugcaggaaaaaguggugucuuucuaugaggcaguaauccgagucaacgaggggcuucccaucauugauaaggaauacaauaagagccugggauggacguuuaaauucaccaugaagcaaaacgagauguuuguguucccuucagaagacuuuaauccaacugagaucgauuugcucgaccagaaaaacgcuagucugauaucccccaaucuauucagaguucagaaguucacaauuaaagauuacuuuuuccgccaccaucuggagaccacaguggaaaacaauaacacucuuaagaacaccacguggaggcgugagggucucucuggcaucuaugggauuaucaagauacggcugaaucacuugggagaaauuguccaggugggcgaguauuga

SEQ ID NO: 3281 - RNA, 4194 nt, Artificial Sequence
  Cas9 variant
augaacgagaauaaggaaugguuccugggccucgacaucgggaccgccagcgugggaugggcugcaacagauacuaacuacaaucuucugaaauugaaggguaaaaaguccuggggcgucagauuauuugacgaggcccagacggcgaaagaaaggcgggauugccgcucuaagcgacguagacuggcuaggcggaaguggcgccuagggcuccuggaggaacuuuucgccgaggagauuaacaaaauagaccccaacuuuuucaugagacugagggaaucaaaguauaaaguuagugauaagaccggaaaugugccuagcaucuuguuuaaugagaaaaacuacacagacaaggaauauuaccggaauuauaagacuauuuaccaccuccgcgcagaucugauccauaaaaacaauccagacauucgagagcuguuccucgccauccaccauauauuaaaguauagaggccacuuucuguucgcuggucaacaguuuaaaggguccgagaucaaggauaacauuagggaacuuuugcaguacaauucucugaacaucaaaauugacaucaccgaugagcuaauaaauaacauugcagaaauccuccugaagaaaaagaacucgacagacaagauuaucgaguucaaaaagcuguuugccgaugaaaaacagcuuaucgaggcuuugcggcucgcccugggaaauaagacccaauuagcgaaacuguucgacauugaggcauacaaggaacucgacauaucaaucaagacuauuagcuuuaaagagaagaucuaugaagauguacguaguaacuacgaggaaauacuuggcgaguauauuaucgugcuggacacagccaaauugaucuacgaugcuauuauccuauccaagauuaaaauaaagaauaugaccaucucugagagcaaggucguguccuaugaaaaacauggcaaggaccugaaacagcucaagcaccugauuaaagaggauuguaaacuuucaaagaaagaaaagcgccagcuguucgagaacaucuucguuaaagaagacgagaagggggccaauuacgugaacuauaucggaaagaauaacgcagguaguagcaagucuuccugcucauacgaggauuuuaaaaaguucuugacgaaggaacucaaauguugcgaggaaagcaagcugaaacaggacauuuuagcugagcuggagcuagaaacuuuucucccgagacaaaggaccaaggauaauagugucauacuguaccagauccacaaagaggaacuugagaagauuuugaacaaugccgugcaguaucaucccuuccugaacaauacagacgaauacggcaucucuauuaaggagaaaaucauacagcuccuggaguuucggaucccuuauuacguagggccacuuaacacuucccacaagguuggagauggcgguuucagcuggucggugcgaaauaaaggguaugaacauauugcggucacccccuggaacuuuaacaaggugaucaauaaagaggaaucugccaagaacuucauugagaaucugacaaaccaauguaccuacuugcucuaugaagacgugcugccuaagcacuccuuacuguacucagaguuugcacuacucaaugagcugaacaguaucaauuacggaggcaaacgccuuacggucgaacacagaaacuugauaauugagagguucuuuaagcagagcgcuccaaaagccacuggcaaggaacugaaaaaguuccucauguccgaggggguuaucgacggaaaggaugaacugucugguuuugacgugagcauuaaaaaugauuuaaagucauaucgggacuucaaaaagauccugggcgauaaauucgacagugagaagguagagaaaaugauacgcuggaucacacuuuuuggggaauccaagcaguugcucguggauaagauuaccaaagaguacggagacaucuauagccuggaagagauuaagaaaaucucuggccuaacuuacaaggauugggguagacugucagagaaacuccugacagaaauagucaguagccaacuuuaugacgaguccaccggggaaugcuucaacauuaucaaugcuaugaggaacaauacguugcuguuuauggaguuacucggcaccaacuacgauuauuucgaaaagaucaauauuuacaaccgucggcugcgaaaggagaucacagagauuacuccccauauacuugacgaucuguacgugucuccugccguuaaaagaucgaucuggcaaguggucaggauuguggaagaguugaagaaaaucauuggaagcgaaccaaagcgcaucuuuguagagaccacacgguccaacaaagaaaagaagggcgacgacgggagaaaagauucaaggaagaaagcacuccuggagcuauauaagaaaauaaagacuuccgacaucguugagcuggaaaaggcccucggacacaccguggauuucgacaaaaagaaacaggaucugacagacauugauaauaacaaacuuaaggcucgcaaguuguaccuguauuacacccaguuaggucgaugucucuauacuggcaaggcgaucgaccugaauaaccuucugucuagcaauuccgaguacgaugucgaccauauuuauccgcagucaaaaacgaaggaugggagcuggaacaaucuagugcucgucaacaaaacagaaaauucuaagaaauccaacggacugaucagugagagcauacagcggaagaauaaacacuuuuggcguuucuugaaggcaaagaaccugauuucugaagagaaauacaagagauuaaccaggacugaggacuuuaccgaugacgaacucuccggcuucaucgcccgccagcugaucgagacaucacagagugugaaagcuguuagccaaauucuucagaaucugaaccccaccacugaaauaugcuuuucgaaggccgagaaugugcaugacuuccggcaggaguuugguaaaaucaagguagggaagagaaggaacuugacagaagaacagcaaaaagaagcaaaggagggccagcucauuaaaguccgagaucugaacgaccuacaccacgccaaggaugcuuaccugaauaucgugguuggaaacguguaucauauuaaauucacgcgcaauccuaagaacuucauccggaagaauaguaaaaacagagaauacacccuuaauacucucuuuuauucugacaagauagagaggaacggcgaggucgccugggaaaaagggaagacagagaaaaucgugagcucaguaauguguaauaaccugauuaaugugacccgucgcacaagugaacagaagggagcauuguacgaugcgacuaucuauaaggcuaacgccgcaaaagaggguuccuacuauccaguuaagaccaaaaauaagaaccugaaagacgucacgcgguacggcggguucaccucuauuaagaucgccuacuauagcauauuuaaauacgauauuagaaauaaggacaaggugaaagaaaacaucaagaucauucccaucccuauauauauuucccagaauaucaaaacagauuuagaccucauuaacuucgcugagaagcaaaucaaacugaagaagggagagaacauagaaaaucuucagcugauuuacaaaaaguugaacaucggcgcccucgugaaaaucgauuauuacccauauuacgucggugggaagacuaaugacaacuuuuacauugacggcgcaguucaggugcugcuaucaagcgauaucgagagguaucugaaagaagugguaaaguucgucaauuuucaacgagagaacaaggaagcuaaagugaguaaggagcacauuucuuccgaggaaaauauagagcuuuacaacacccuccugugcaaaaugacagccaagaucuucacucauaccaaaaauaacaaguauaaugacuuggcgcaggauaaggccaaaaacacguuuaagaauuuaagccuggaggagcaguguaaaguucuccuggagauucuuaaccuguugacaaauaagaaaaccacuuucgaccuaucgcugaucaacgaaaaggcuucacgggugaaaugcggauuuaaccuccugaaucagaagcaauucucuaucauugagcagagugucacaggccuuuacgaaaaggagauaaaaaucauugaagauuga

SEQ ID NO: 3282 - RNA, 4197 nt, Artificial Sequence
  Cas9 variant
auggagacccaggccagcaaccaacugaucuccucucaccucaagggcuaccccauuaaagacuauuucguggggcuugauauaggaacaucaagugucgguugggcuguuacuaauaaggcauacgaacuguugaaauuuagaagccauaagauguggggcuccagguuauucgacgagggggaaucugccguggcgcggcgcggauuucgaucgaugcguagaaggcuggagcggcgcaaacuaagacucaagcugcuugaagaacuguucgcugaugccauggcacagguagacccuacguuuuucaugagguugcgggagucaaaguaucacuacgaagauaaaaccacaggccauagcaguaagcacauccucuuuauugacaaaaacuauaaugaucaggacuacuucaaggaguauccaacuguguaccaucugcgcuccgaacugaugaaaucugguaccgaugacauccgaaagcucuuuuuagccguccaccacauucugaaguacagagggaacuuccuuuaugagggagcuacauuugauagcaaugcauccaccuuggacgaugugaucaaacaggcccuggagaacauaacuuucaauugcuuugacuguaacucagcuaucaguagcauuggccaaauccuaauggaagccggcaagacaaaaucugacaaggcgaaagcaauugagcaucucguugauaccuacaucgccacggacacuguggauaccuccucaaagacacagaaagaccaggucaaggaagauaagaaaaggcugaaggcuuucgccaaucuugugcugggguugaacgcaagccucauagaccuguucggaaguguagaggaauuagaggaggaucugaaaaagcuccagauuacuggugacaccuaugaugacaaacgggaugaacuugcuaaggccuggucugacgagaucuacauuaucgacgauugcaaguccguuuaugacgcgaucauucuguugagcauaaaagaaccgggccuaacaaucucggagucuaaggugaaagccuuuaauaagcacaaagaugaccuggcaauucucaagucccugcuuaagucagaucguaguaucuacaacaccauguucaaagucgacgaaaaggggcugcauaauuaugugcacuacauaaaacaaggacgcacggaggagacuagcuguaacagagaagauuuuuacaaguauaccaaaaagauuguggagggcuuguccgacucuaaggauaaagaauacauccucagccagaucgagcugcagauuuuacugccccuacagaggaucaaggacaauggugucauuccuuaucaacuccaccuggaggagcuuaaagcuauauuggccaagugcgggccaaaauuccccuuucugaacgagguugcugauggauucucaguggccgaaaagcucaucaaaaugcuggaguuucggauuccuuacuauguaggcccacuuaacacacaucacaauguggacaacggcggguucgcaugggccguccgaaaggcuaguggacgcgugacucccuggaauuuugaugacaagaucgacagagaaaaauccgcggcagccuucaucaagaaccugacaaauaaauguaccuacuugcucggugaggauguucugccuaagagcucuuuacuguauucagaguuuaugcuacucaacgaacugaauaacgugaggauugacggcaaaccacuugagaaggucgugaaggaacauuugauagaggcuguauucaaacaggaucacaagaaaaugacgaagaaucggaucgaacaguuucugaaagacaacggguacauuagugagacccauaagcacgagaucacaggacucgauggcgaaauuaagaaugaccuggccagcuaccgcgauaugguuagaaucuuaggugacggguucgauagguccauggcagaggaaauaaucacugacauuaccaucuucggcgagucuaaaaagaugcugcgugaaacacuucggaaaaaguuugccucgugcuuggaugacgaggcuauuaaaaagcucacuaagcugcgauauagagauuggggaaggcuaagccaaaaacugcucaacggcaucgaggggugugacaaggccggagacgguaccccggaaacaauaauuauccugaugcgcaauuucuccuacaaccuuauggaguugcugggcgauaaauuuucauucauggaacggauucaggagaucaaugcaaaguuaaccgaagggcagauagugaacccccacgacaucauugaugaccucgcgcugaguccugcugucaaaagagccguguggcaggcacuuaggaucgucgaugagguggcccauauuaagaaagcucugccagcccgcaucuuuguugaggugacucgaucuaacaagaaugaaaagaaaaagaaagacagccggcaaaagcguuuguccgaucucuaugcagcuauuaaaaaggacgauguacugcuaaacggacugaauaacgagauauucggcgaacucaagucaagccuggccaaauacgacgaugcggcccuuagaucuaagaaauuguaucuguacuauacgcagauggguaggugcgcuuacacaggggagaucaucgaguuaucccuccugaauaccgacaacuacgacauugaucacaucuauccccgcagucuuacuaaggacgauagcuuugacaaucugguccuauguaaacggaccgcaaacgcccagaagucugaugcuuacccuauuuccgaagagauacagaagacacaaaaaccauucuggaccuuucucaagcagcagggccugaucucagaaagaaaauaugagagguugacucgaauuacaccccugacggccgacgauuuaaguggauucaucgcacgccagcucguggaaaccaaucaaagcguuaaggcggccacuacacugcuucggagacuguacccgggcguggacgucguguuuguaaaagcugagaacgugaccgauuucaggcaugacaauaacuuuauuaagguucguucguugaaucaccaccaucacgccaaggaugcauaucucaacaucgucguggggaauguguaccaugagcgcuucacacggaacuucagagccuuuuucaaaaagaacggagcuaauaggacuuauaaccuggcaaaaauguuuaauuacgacgucaacugcaccaaugccaaggaugguaaggcuugggacguuaaaacguccauggacaccgugaagaaaaugauggauucuaacgacgugcgaguaacaaagcggcuacuggaacagacuggcgcgcuugccgaugcaaccauauacaaagcuacagucgccgggaaggccaaagacggagcuuauaucggcaugaagacuaaaagcucaguguucgcagauguuaguaaguacggugggaugaccaagauuaaaaaugccuauuccaucauugugcaguacacgggcaagaaaggagaggucaucaaggaaauagugccucuccccauuuaucugacaaaccgcaauaccacugaccaggauuugaucaacuacguugcgucuaucauuccacaagcuaaagacauaagcaucauuuauggcaagcuguguaucaaucaguuagugaagguaaacggguuuuacuacuaucucggaggcaaaacaaauuccaaguucugcauugauaacgccauccaggucauagugucaaaugaguggaucccuuaccugaaagugcuugaaaaguuuaacaacaugagaaaagacaauaaggaucugaaggcaaacgucguuagcaccagggccuuggacaauaaacacacuauugaggugcggaucguagaggaaaagaacauugaguucuuugauuaucucgugaguaaacugaagaugcccaucuaccagaaaaugaaggguaauaaggcugcagaacuaucugagaaaggguauggacuguucaagaaaaugucccuugaggaacaaagcauacaucucauugagcuguugaacuuacugaccaaucagaagacaacguuugaagucaaaccacucggcaucaccgccucgcgaucaacuguggguucuaagaucaguaaccaggacgaguucaaaguuauuaaugaauccaucacaggccuguacagcaacgaggugaccauagucuga

SEQ ID NO: 3283 - RNA, 4197 nt, Artificial Sequence
  Cas9 variant
auggaaaagagcuacuccaucggccuggacauugggaccaacucugugggauggucagucauaacagaugacuauaaaguucccgccaagaaaaugagagugcucgguaauacugauaagaaauacaucaagaagaaccuucugggcgcuuuguuauucgacaguggggaaacggcagaggccaccaggcugaaacggacagcgcgccgacguuauacuagaaggaagaaucggcuacgcuaccuccaggaaauuuuugcuaaagagauggccaagguagaugagagcuucuuucaaagacuggacgaguccuuccuuaccgaugacgauaaaacauuugacucucacccuaucuucggaaacaaggcagaggaagaugccuaucaucagaaguuuccaaccauuuaccaccugaggaaacauuuggcugacucgcaggagaaggcagaucuccggcugaucuaucuggcccucgcucacaugauaaaauuccgcggccacuuuuuauacgacaauuucaacgacgauaauuuugacuggcgaaacaucgauauucagaagagauacgaagaguucaucgagacuuaugacucaacacugggugaaagcuaccuugccgauauuaguguggacgcggcauccaucuuggaggaaaaagucucuaagaccgagaggcuggaaaaucuacucaaauauuacccgacggagaagaagacuaccuuuuucgggaaccugauaaaacuuauucugggacaacaggccaaguucaaagcuaucuuuaauuuggaggaugaaauuagccuccaguucgccacacccacuuaugacgaggaucuggaagaguuacugggcaagaucgacaacggcgauuccuacucagaacucuuuguggcagcucagaaucuuuauaacaccauccuguuggccaguuuccuaaaaacagacaauaagagcgcgaaggccccucugucuaccuccaugauugagcgguacgagaaccauaaaaaggaccucgcaaaacugaaggauuuuguuaaaaagaacugcccagaccaauaccacgauauauuccgugacaagucaaagaauggguaugcuggauacaucgauaacggugugagccagaaugacuuuuauacguucauuggcaagugucuugaagagagucugaaaaaggauaaaggggcccaguacuuuuuggacaagaucgaucgcgacgauuuccucagaaagcagaggacuuuugacaacggagcuuuccccuaucaaauacaucugcaggaaaugcacgccauuuuacggcgacagggcgauuacuauccuuuucugaaagagaaucaagacaagaucgagaaaauccuaacauuccgcauuccauacuacgucgguccccucgcaagaaaggacucuagguucgccugggcuaacuaucgguccgaugaagcgaucaccccuuggaauuuugacgaggugguagauaaagaaaagagcgcagagaaauucauuacucgcaugacacugaacgaccuuuacuugccagaagagaagguucugccgaagcauucgcucauauaugagaccuuuacgguguacaaugaacugaccaacaucaaauaugucaaugaucaggggaacgccauucacuucgacucugagcuuaaggagaaaaucuuuaaucagcuguucaaggaaaacagaaaaguguccaagaagacauugaucgauuuucucaauaacucagaaggaauuuacacugacaaacuggugggcauagaugaggaggucaaguauuuaaacgcuagucugggcaccuaccacgaccucaaaaagauccuagagagcuucauggaugacgaaauuaaugagaaaaucauugaagauaucauacagacacugacucuuuuugaagacaucgagaugaagaggcaacguuugcagaaguacgacgauauuuucacccccaaacagcugaaggagcucgcccggcgaaacuauacaggguggggaagacuguccuacaaauuaaucaaugguauuaggaacaaggaaaauaacaaaaccauccuggacuaucuuaagaauggcaaccgcaauuuuaugcaguugauaaacgaugaccggcucucuuucaagcaaauuaucauugaugcaagaaaaaucgagaagcuggacaauauagaaagcguuguguacaaccuaccugggucaccagccaucaaaaagggcauucugcagaguaucaaaauuguagaugagcucgugaaggucaugggacauaaucccgacaacaucgugauagaaauggcuagggagaaucagacuacgaaccaggguaaaaaccgcucccaacagcgacugaagcggcuucaggauagcaugucuaauuuuaaggacucaaguauuagcuugaaagauguugacaacuccgaccugcagaaugaucguuuauuccucuauuacauccaaaacgggaaggacauguauacaggcgaggaacuggauaucgaccaccuuucugauuacgacauugaucauaucauuccucagucguucauaaaagacaauagcaucgauaacagagugcugaccuccucagccaagaauaggggaaaaagugacgaugucccaggccgcgacgugguauugaagaugaagcccuuuuggaaaaagcucuacgauguuaaacugauuucuaagcggaaauucgacaaccuaacuaagagcgagcacgggggacugaccgaauccgacaaggcagguuuuaucaaaagacagcucguggagacaaggcaaauuaccaaguaugucgcgcagauccuggauggccgauucaauacuaaacgcgacgauaacaauaaggugauacgggacgucaaagugaucacacuuaagagcucauugguuucucaguuuagaaaggauuucggguuuuacaaagugagggagauuaacgacuaucaucacgcucacgaugccuaccugaaugcaguagucggaacggccaucuuaaagaaauauccgaagcucgcuccugaguucguguacggcgaauauaaaaagugcgacguucguaagcugauugccaaauccggugauaagagugaaaucgggaaagcaaccgcuaaguacuuuuucuacagcaaccuuaugaacuuuuucaaacgcgugauacgguauucuaauggcaugauugucgugagacccguaaucgaguacuccaaggacacuggagaaaucgccugggauaaagagaaggacuucaagacaguguguaaaguucugucaugcccacaggucaacauugugaagaaaguggagaagcaaagucauggccuagauagggggaaaccuaagggauuuuauaaugcgaaccccagcccaaagcccaaaaaggguucgaaagucaaucucguuccuauaaaggccaaccugaauccgaaaaacuacggcggguaugcuggaaucuccaauucuuacgcaguguugguggacgccaccauugaaaagggcgcuaagaaaaagcugacacgaauccaggaguuccaggguauuagcaucauagaccgggaaaaauaugagaagaacaaaguagaauuuuuaaaggggcucggcuacaaggagaucuacucaauuaucacucugccaaaauauagucuuuucgagcuggccgauggaucccgcagaauguuggcaucuauucucagcaccaauaacaagaggggcgaaauccacaaagggaaugagcugguccuacccgcgaaguacauaccucugcuuuaucaugccaaccggauucacaauacguuugaaaccggacaccgagaguacguggaaaaacauaucgcugaguucaaggagaucgccgaaauuauccucgaguuuaacaauaaauauguuaacgcaaagaaaaauuccucaauaauugaaaaagcucuggagagcuucgacaguuuuucuuuggaugagaucugugacuccuucgugggcaagcugaaaaagaacaacacuaaaaagaauagcgguuuauuugaacucgucucgcuggggucagccucugauuucgaguuucuugaaacaaaggugccaagauaccgcgacuauacccccaguucccuguugaacgcaacacucauucaccagagcaucacuggacuguacgagaccaggauagaucuaucuaaacugggcgaagaguga

SEQ ID NO: 3284 - RNA, 4197 nt, Artificial Sequence
  Cas9 variant
auggagacccaggccagcaaccaacugaucuccucucaccucaagggcuaccccauuaaagacuauuucguggggcuugauauaggaacaucaagugucgguugggcuguuacuaauaaggcauacgaacuguugaaauuuagaagccauaagauguggggcuccagguuauucgacgagggggaaucugccguggcgcggcgcggauuucgaucgaugcguagaaggcuggagcggcgcaaacuaagacucaagcugcuugaagaacuguucgcugaugccauggcacagguagacccuacguuuuucaugagguugcgggagucaaaguaucacuacgaagauaaaaccacaggccauagcaguaagcacauccucuuuauugacaaaaacuauacugaucaggacuacuauaaggccuacccaaccaucuaccaucugcgcgcugagcugaugaaagaugguacauaugacauucgaaaacucuucuuagcagugcaccacauccugaaguacagagggaauuuucuuuaugaaggagccuccuucgauucuaacgcuagcaccuuggacgauguccugaaacaggcccuagagaauauaacuuuuaacugcuucgacuccucagcggcaaucggcaguauuggccaaauccucauggagacagggaagaccaaaagcgacaaggccaaaacgauugaaaggcugguggauacuuacaucauaaccgacgagguuaaugcuucuggaaagacacagaaagaucaggugaaggaagacaagaaacggcuuaaggccuuugcaaaccuggucuugggucucaaugcuucccugauugauuuauucggcucaguggaggaacuggaggaggaccucaaaaagcugcagaucacuggggauaccuaugacgauaaacgugacgaacuugccaaggcguggagcgaugagauuuacaucaucgacgacuguaagaguguauaugaugccauuauauugcuaucuaucaaagaaccgggacugacaauuuccgagagcaagguuaaagcauucaacaagcauaaagacgaucucgcuauccugaagucgcuucugaagucugaccgcuccauauacaaugccauguuuaaaguggaugaaaagggcuugcacaacuacguccauuauauuaaacaagguagaaccgaggagacgucaugcaauagggaagacuucuacaaguauacuaaaaaggugguggaggggcuccccgauaguaaggacaaagaauacauccugagcgagaucgaauuacagacacugcuaccucuccagcggauuaaggauaacggagucaucccauaucagcugcaccuugaggaguugaaaguuauucuggcuaaguguggccccaaauuuccuuuccucaaugaaguggccgacggcuuuuccguagcagagaagcugauaaaaaugcuugaguuccgaaucccauacuauguggggccccugaacaccucucacaacgucgauaauggagguuuugccugggcugugcgcaaggcgagcggcagaguuacuccuuggaacuucgacgauaagauugacagggagaaaucagcagccgcuuuuaucaagaauuugacaaacaaaugcaccuaccuccugggggaggacguguuaccaaagaguucccugcuauacagcgaguucaugcuccugaaugaacuuaacaauguccggaucgauggaaaaccguuggaaacgaaggugaaggcccaucugauuaaagcaguauuuaagcaagaccacaaaaagaugaccaaaaaccgcauagagcaguuccucaaggauaauaacuauauccccgaaaagcauaaaccugagauuacaggccuggacggugagaucaagaaugauuuagccucuuacagagacaugguuaggauucuggggaacaauuuugaucuuucaauggcugaagagaucauaacugacaucaccauuuucggcgaaaguaaaaagauguugcgugagacacuccggaaaaaguucgccagcugucuggaugacgaagcaaucaagaaacuauccaagcugcgauauagagauuggggaaggcucucuaaaaagcugcuuaacggcauugacgggugcgauaaagcgggagacgguacuucggugaccaucauagaggcuaugcgcgacuuuagcuacaauuugauggagcuguuaggcgaucgguuccucuuuauggaaagaauacaggagaucaacgacaagcugacagaagggcaaauugucaacccacacgauaucauagacgaucuugcccugucccccgcagugaaaagggccgucuggcaggcuuugcgcaucguggacgagauuguucauaucaagaaggcccucccugcacgaauuuucguggaaguaacccggucaaauaaagcugagaagaaaaagaaagauagucgucagaagagacugucugaccuauaugccgcgaucaagaaagaugacgcccugcucagcggacugacuaacgaggaauuuggcggucuuaaguccgaguuggcuaaauacgaugacgcagcccugaggucaaagaaauuauaucucuacuacacgcagauggggcgcugugcuuauacaggcgaagucauagaccugagccaacuuaauaccgauaacuacgacauugaucacaucuauccacggucucugacuaaggacgauuccuucgacaaucuagugcucugcaagagaaccgccaacgcacagaaaagugauacauaccccaucagcaaggagauucagaaagcgcagaaggccuuuuggaucuuccugaaacaacagggauugauuucugagaggaaguaugaacgacugacccgcauaacuccguuaacagcugacgaucucuccggcuuuaucgcccggcagcugguugagacgaaucagucagugaaggcagcuaccacucuucugagaagguuguacccugacauugaugucguguucguaaaagccgaaaacgugacagacuuucgucacgauaauaacuucaucaagguucgcagucucaaucaucaccaucacgcaaaagacgccuaucugaacauugucguggggaauguguaccacgagaaguuuacccggaacuucagagcuuucuuuaaaaagaauggagcgaacaggacauacaaccuagccaagauguucaauuaugacgucaaauguacuaacgcaaaggaugguaaggcuugggacguuaagaccagcauggauacggugaauaaaaugaugaccucgaacgacgugcgaguaacaaagcggcugcuugaacaauccggcgcccucgccgaugcuacugucuacaaagcaaccguggccgcgaaggcuaaggacggggccuauaucggaaugaaaacaaagucuagcguuuuugcagaugugacuaaauacggcgguaugaccaagauuaaaaaugccuauucaaucauuguccaguacaucgggaagaagggcgaggugguuaaagagauugugccccugccaaucuauuugacgaaccgcaauauaacagaccaggaucugauugacuacguagcuaguaucaccccucaggcaaaggauaucuccauuauauacagaaaauuaugcaucaaccaacucgucaaggugaauggauucuauuacuaucugggcgggaaaacuaacucuaauauuuacaucgacaacgccguggaagucguugugcccgcgaauauugcuguauauaucaaggugcuugagaaguuugcccuguugcauaaagauaacaauaacauaaaggcaagcacagucaccacuaggaucuacaacgaaggauccaccaauauugugucaaucacagacaaagacggccucauuguuuaugauuaccugaugagcaagcuacggacgccacuguacaugaaaaugaaggguaacaagguggacgagcuuaguaccgucgggcgaucuaaauucaugaauaugacucucgaggaacaguccaucuaucuguuggagguguuaaaccugcucacaaauagcaagaccacauuugauguuaaagcccugggaauaacugcuucgagaucaaccauuggcgugaagauccacacgcuugacgaguucaaaaucauuaaccagucuaucacaggucuguacaguaaugaaauaaccauugucuga

SEQ ID NO: 3285 - RNA, 4197 nt, Artificial Sequence
  Cas9 variant
auggagacccagacaagcaaccaacugaucacuucccaccucaaggacuaccccaaacaggauuauuucgugggccuugacauugggacaaauucugucggaugggccguuaccaacacaucauacgaacuguugaaguuucauagucacaaaaugugggguagcagauuauucgaggaaggcgaguccgcugugacuaggcggggguuucgcucuaugcgacguagacuggaaaggcggaagcuacgccucaaacugcuugaggagcuguucgcagaugccauggcgcagguagacucgaccuuuuucauaagauugcaugaaucaaaguaucacuacgaggauaagacaaccggacauagcaguaaacacauccucuuuauugacgaagauuauacugaccaggauuacuucacagaguauccuaccaucuaccaccugaggaaggaccugauggagaauggcacggaugacauucggaaacucuuuuuagcugugcaucacauccugaaguaccgcgguaacuuccuuuaugaaggggccacuuuuaauuccaacgcauucaccuuugaggaugucuugaaacaagcccuggugaauauaacauucaacugcuucgacacuaauucugcuaucagcuccauuucaaacauccuaauggaaaguggaaagaccaagagcgacaaagcaaaggccauugagcgacucguugauacauacaccguguuugacgaagucaauacgccagauaaaccgcagaaggaacaggugaaagaggacaagaaaacucugaaggcuuucgccaaccuuguacugggcuugucugcgaaucucaucgaucuguuuggcuccguugaagacauagaugacgauuuaaagaaacugcagauugugggggacacauaugaugagaagagagacgaacucgcaaaagucuggggagacgagauccauauuaucgaugacuguaagucaguguacgaugccaucauucuuaugagcauaaaagaacccggucugaccaucagucaaucuaaggugaaggcuuucgacaaacacaaggaggauuuggucauucuaaaaucccugcucaagcuggacaggaacguuuauaaugagauguuuaaaagcgauaagaagggccuucacaacuacgugcauuauaucaaacaggggcggacugaagagacaucgugcucucgugaagacuucuacaaguacaccaaaaagauaguagagggacuggccgauuccaaagacaaggaauauauuuugaacgagaucgagcuccagacgcuguuaccucugcagcgcaucaaggauaauggcgugauuccauaccaacuacaccucgaggagcugaaagucauccuugacaaguguggucccaaauuuccuuucuugcauaccgugucagauggguuuaguguuacagaaaagcugauuaaaaugcucgaguucagaauaccauauuacgugggaccccugaacacucaccauaauaucgacaacggcggcuuuagcugggcagucaggaagcaggcugggcgggugaccccuuggaauuucgaggagaaaauugaccgagaaaaguccgccgcggccuuuaucaagaaccuuacaaauaaaugcacuuaucuguucggagaagauguauugccaaagucuagccuccuguacucagaguucauguuacugaacgaacuaaauaacguucgcaucgacgguaaagcacucgcucagggcgugaagcaacaccugauugauaguauauuuaaacaggaccacaagaagaugaccaaaaauagaaucgagcuuuucuugaaggauaacaauuauauuacgaaaaagcauaaaccggagaucaccgggcuggacggagaaauuaagaacgaucucacuuccuacagggacaugguccggauccugggcaauaacuuugaugugagcauggccgaggacauaaucacggauauuacaaucuucggugaaucuaagaaaauguuacgccagacccugagaaacaaguuugggucacagcuuaaugacgagacuauuaaaaaguugaguaaacucagguaccgugauuggggccggcugagcaagaagcuacugaaaggaaucgacggcugugacaaggcugggaacggagcccccaaaaccauaauugaacucaugcgaaaugauuccuauaaccugauggagauccuuggugacaaguucucuuuuauggagugcauugaagaggaaaaugcaaaauuggcccaaggccaggucgugaacccucacgauaucauagacgagcuggcuuuaucgccagcgguuaagagagcaguguggcaggcccucaggaucguagaugaagucgcucauauuaaaaaggcccugcccagccgcaucuucguggagguugcacggacaaauaaguccgagaaaaagaaaaaggacucaagacagaaaaggcuuagugaucuguacucugccauuaagaaggacgauguguugcaaagcgggcuccaggacaaagaauuuggagcucugaaguccggccuagccaacuaugaugacgcagcgcugcgcagcaaaaagcucuaccuguauuacacccagaugggucgaugugcuuauacugggaauaucauagaccuuaaccaguugaauacagauaacuacgacauugaucacaucuacccucggucacugacgaaagacgauucuuucgacaauuuaguccucugcgagcguaccgccaacgcaaagaaguccgauaucuauccaauugacaauagaauccaaacuaaacagaagcccuuuugggccuuccugaaacaccagggccuuauuagugaaaggaaguacgagcgccugacacggauagcuccgcuaaccgccgaugaccucagcggauuuaucgcaagacagcugguggagacaaaccaaucuguaaaagcuacuaccacguugcugaggcgauuauauccugauauugacgugguuuucgucaaggccgaaaacguguccgauuuccgccauaauaacaauuuuaucaaggugcggucacucaaccaccaucaccaugcgaaagacgccuaccugaauauugucguuggcaacguguaucacgagaaguucaccagaaauuuuaggcuuuucuuuaaaaagaacggggcuaaucguacauacaaccuggcaaaaauguucaauuaugacgugaucuguacuaacgcccaggauggaaaggcuugggacguaaagaccaguaugaauacagucaaaaagaugauggccagcaacgaugugcgcguuacucggagauugcucgaacagucgggugcacuggcggacgccaccauauacaaggcuuccguggccgcaaaagcuaaagauggcgccuacaucgggaugaagacgaaauauucugucuuugcagacgugacaaaguacggaggcaugaccaagauuaaaaaugccuauagcaucauuguucaauacacugguaagaaaggggaggaaaucaaggagauagugccccuaccaauuuaucugaucaacaggaacgcuacagauaucgagcuuauugacuacguaaaaucagucauaccuaaggcgaaggauaucaguauuaaauaucgaaagcucugcaucaaucagcuggugaaagugaacggcuucuacuacuauuugggaggcaagaccaaugacaaaauuuacaucgauaacgccauagaacuggucguuccccacgacaucgcaacuuauauuaaguuacucgauaaguacgaccugcuucggaaagagaauaagacccugaaggcuuccucuaucacaacgagcauuuauaacaucaauaccuccacugugguaucauugagcaacaaaguggggauagacgucuuugauuacuucaugaguaaacuccgcacaccacuguauaugaagaugaagggaaauaaaguggacgaacuaucuuccaccggcagaagcaaguuuauuaaaaugacacuggaggaacagucgaucuaccuucucgagguucugaacuuguuaacuaauucaaagaccacguucgaugugaaaccccuggguaucacagggucuaggaguaccauuggagucaagauccauaaccucgacgaguucaaaauaauuaaugaauccaucacuggccuguacagcaacgaggugaccauuguuuga

SEQ ID NO: 3286 - RNA, 4200 nt, Artificial Sequence
  Cas9 variant
augaagaccauccugggccucgaccuugggacaacuagcauuggaugggcccuggugaaagaggcugaacccuucuccgaugagaagucugaaauagucagauuggguguuagggugaucccuuuaacgguagacgagcggaccucauuugaaaacggcaaaaguauuacaacuaaugcacugcgcacccagaagcgagggaugcguagaaaccuacaaagguacaaacuccggcgccaggcccugaucgaggagcuuaagagcacaggauggauuggcaaugauuucaucuuuuccgaaaccgguccagggucuacuuucagaacacugagguugcgggcgaagucggcuucagaggaagugacccucggagaccuggcccgcauacugcuccagaucaacaaaaagcgaggcuauaaaagcaguagaaagauggucuccucugaugacggccaggcaauugaugggauggccguggcuaaagagauguacgacaagggauuaacgccgggugaguauguuuaccaaaggaugcuggaaggcaaguaugcaauccccgaguuuuacaaaagcgaucuucaggaagaguucgaccggauuugggccuugcagaaguccuuucacaucgaacugacugaugagcuauaucguaaacucucagaccgcaauaagagucagaccugggcuauaugcagagaugagcuggggauucaaggacuuaaaagcucuuucaucggcaaggaaaggcugaaagaggccuaccgguaccgacauuuggcggcaacacaggaagugaacauggagguccucacuugugcccugcaggaaauuaauggucagaaggcuuccuuaucagggcugcucagcaagaucagugaccgcucuaaagagcuuuaucugaacaauuugaccgugggacaaaugcuacugaagagaaucgaggacaacccuaauaacucccucaaaaauauuguauuuuacaggcaggauuaucuggacgaauuugagcggauauggacaguucagagcaaguaccacaccgaacuuacgcaugagcugaaaaagcgcuugagagauaucauuaucuuuuaucaaaggccacucaagucgcagaaaggccugauaucuuuaugcgaacuggagacuaaggacauugagguggccaucgauggcgucaaaaagaugaaaaacaucgggccccguguguguccucgguccucaccacuauuccaggaauuuaagauuuggcagacaaucaauaacauuuucgugaacggagcagcucucgacgaugaggacaagagugucauagccaaagaacugauguucaaggauaaacuuaaggacagcgauuugcugaaacuccuguuuaagaccacuaagggucaauccguuaauuucaaagagguggacggcaaccgaacaauggcgacccuuaugaaggccugcuuuaaaaucgcagagaaucugggguacgacgauauuggauugucuaagcucagcucagaagaccagaugguaagaaucgagggcaucuucaaagaacaggguuuuaagacgggguuccugcacuuugauaguuccuuagcuagccccgaguucgaaaaccaggacucuuauaggcuguggcaucuacucuacucauacgagggcgauaaaagugccagcggaaaugagucccuggugaaguguauuauggaccuuugcucuauggaugaaggcucggcuaagauauuggccagcuguaccuuucugccugacuaugggucccucucagcaaaagccaugcgcaagauccugccauacaugaaagauggauuagaguauacagcugcgugcgcaauggccgguuaccggcacaguaagagaucucugacuaaagaagaacuugacaccaaggaauauagcgauagguugucccuccugccgaagaacucacuacgcaaucccgucguggagaaaauucugaaccaaaugaucaauguugugaacagcgucauugacguguacggcaagccugaugagauccgaauagaaauggcucgggagcucaaaaagucugccaaagaacgugaggaagcacagagagacaucgccuccaguacagcugagagccagaagguaauugagauccugaagggggaaccauucuuucuucaguuccccacuaggaaugacauuauccgcuaucgguuguaccaagagcuggcccagaacggauuuaaaaccuuauacucuaauacauauauaccuaaggauaaacucuucuccaaggaguucgacauugagcacaucauuccacaggcacugaucuuuaacgauucauucgcgaauaaaacccuugagaguagacaguguaaccuggaaaagggcaaggagacugcuauggacuacguuaaaagcaaguaugaugaaacgggugugcaaacauacugcgacagggucaacggguugauaggcaaaggaaucucgaagaccaaagccaaguggcuccugauggagggcaaagauauucccgaagacuuuaucaaucgagagcuacgcgauucccaguauauugcaaagaaggcccgggagauccuggaaucucucgugaaauucgucgugccgacuaccgggagcguuacagcuagacugagggaggacuggcagcuugugaacguaaugcaagaauugaauugggagaaguacgcccgucugggauuaaccgguguccgcgaagauaaagacggccggagaauaccuuuuauucaggauuggacuaagaggaacgaccaucgacaccaugcaauggacgcucucacaaucgccuucacgcggcgccaguuuauccaguaucugaaucaccuuaacucaaaaauugaugugguuaguugggacaagaaggaucuggaccuaagagauuacgaccucgaggauaucaaauucgggaaucuguccgcgggagacagguacggcauugugaaggccuugcaagauaaauuucuguauaaggacgguaacgauaaauaccgguucgugcccccaauaccuuuagacgaguuucgaagacaggcuaaggaacagcucucugacauccugauuagcuucaaggcaaagaauaaggucuguacccgcaacguaaaugugacuaaaaacaaagggggcgccaauaggaaagcucagcuuacaccccguggaccacugcacaacgagaccaucuauggcuccucauuggaauacguuacaaaggagaaugaaaagauugggagcaguuuugauacugagcggaucaccacggucugcaaaaagaaauucagagacgcccucgcaaggcgccuggaggaguucggaggcgaucccaagaaagcguuuaccgguaagaacucuccugaaaagaacccaauauggguggacgaacaucacuccgagcaagugccggccaaaguccgaacaguuacuauggggcagagauucaccggacggaagcccaucgaugcuacacuaaaaauugagaaggugaucgacaaaaggauucgcgaaauccugcaggcccgucuugaugaguuugacggcaaggcagcuaaagccuucagcaaucucgaugaaaacccuauauggcugaauaaggagaaggguauugcaaucaaaagagugacuguaucgggcccagccaaccccgucccugugcgguuuaagagggacaaagaugggaagccaaucauugacgaugcuggaaaaaccauaggcgcggacuucguuacgcccgggaauaaccaucacaucgccauuuuucgcgacucaucuggaaaguugcaggaacauccggugaguuuccuggaggcaacaaucgcuaagucccacggcuuagaugucauugaccgaaauuauaacaaagaugaggguugggaauuucucuucacccugaagcaaaaugaguacuuuguguucccuaacagcgaaacuggguucaauccacuugacuaugaucugacagaccccagaaacuacgccgagaucucuccuaauuuguaccggguucagagcauauccaccaacgauuauuucuucaggcaccaucucgaaacuaccucagagaaaaauaacagucuguacggaaucacauggaagcgcauuagaaacgccagcgcucuagagggccuggugaaaguaaggaucgacaaucuuggucggauugucgcagugggcgaauaugauuga

SEQ ID NO: 3287 - RNA, 4200 nt, Artificial Sequence
  Cas9 variant
auggagacccaggccacagcucaacugaucagcggccaccucaagggguaccccauuuaugacuacuucgugggacuugauauagguacuaacuccgucggcugggcaguuacgaauagaaucuaugaacuguugaaauuuaggucucauaagaugugggggucacgguuauucgaggaaggacagaccgccgugguacgccgaggcuuucguaguauuagaaggcggcuggagcgcagaaggcuacggcucaaacugcuugaagcgcuguucgcugacgccauggcacgcguggauagcacauuuuucauccgauugagagaguccaaguaccacuaugaggacaaaacuaccggucauaagucuaagcacauucucuuuaucgaugacaacuacacagaucaggacuauuucgccgaauacccuaccauauaccaucugagggcugaucugauggagaaugggacuucggacauccggaaacucuuuuuagcaguccaccacauucugaaguaucguggaaacuuccuuuacgaaggcgccacauuugauucaaauagcaguuuggacaccgugcugaaacgcgcucuagagcagaucgaguuccauauuuuuaacgccacguccgaagaugcgcuccacucuauccuggacauaguuaaacuucaagacaaaacuaagagcgauaaggcaaaagccauugagucccugguggacaccuauaucacagauaaggucgaaucaaguugcacugacaaagagaagaaagauuugcucaaggcugacaaaaagagacugagggccuucgcaaauuuaauucugggccucaacgcuaaucuuaccgaucuguucgggacaaucgaagagaucgaggaagacuuugugaaguugcagauuaccggagauacguacgaggaaaaacgggacgauuaugccaagguauggggugacacuauacgaaucauugacgauuguaaaagcguuuacgacucuaucauacuaauguccauuaaggagccaggccugacaaucucacagagcaaagugaaggcguucaacaagcauaaagaagaucucgccauccugaagcgccuucugaaaagugacaaguauauuuacaaaaauauguuuaaggcagaugagaagggguuggcuaacuacguccacuauaucaaacagggaagaaagaaugagaccggcugcucuugugaagacuucuacaaauauacuaagaaagugguggagucccucccggauagcucggacaaggccuacauucugaacgaaauagaguuacaaaagcugcuaccccuccagaggaucaaagauaauggugucauuccuuaucagcugcaccuugaagaguugaaggcuauccuggagaaaugcaaggacacauuuccauuccucaacaccguuucugauggguuuacgguggccgaaaaacugaucaagaugcuugaguuccggauucccuacuauguaggaccucugaacccaucccauucaauagacaaaggcggcuuugcauggguggaacgcaaggagcccgggcaggucaccccuuggaauuucgaggauaagaucgacagagaaaagagugccgaggcuuuuauuaagaacuugacaaauaaauguacuuaccucaucggagaagacgugcugccaaagagcuccuuacuguacucugaguucaugcuacucaacgaacugaauaaccuuaggauugaugguaaaccguuggagcaagcgguuaagaugcaccugaucgacgcaguguuuaagaaagagcauaagaaacagaccaagaaucguauaaucgaguuccucaaagauaacaauuauauucugggcaagcacaagcccgaagucgacggguuagaugaaagcaucaaaggagaccuggccucauaccgggauaugaagcgaauccuuggcgacgauuucgacgugaguauggcugaguccauuauaacaagcauuacuaucuuuggugaaucuaaaaacauguugagagagacccucaggaagaaauucgggucaauucugagugaggaucagauccgcagccuagccaagcugcgguauagagacuggggcaggcucuccaagaaauuucugauaggaaucgauggcugcguaaagggggaagacggaacaccugguaccauuaucgacaugaugcgcaauacuucucauaaccuuauggaguugcugggcgauacguucucguuuauggacguuauuaucgaagagaaugauaaauuaacaaaggggcaaguggucgacccacacgaaauaauugaggagcucggacugagccccgcagugaaacgagccgucuggcaggcccuucggaucguggaugaaguuauccacauuaagaaagcucugccuucccguaucuucguggagguagcaagaaccaacaaggacgaaaagaaaaagaaagauucaaggaagaaacgcuugcaggagcucuacaagaguauucagaaggagucuccagaauggcugagcgucacucgggacgaguccgauaaacuaauaucaaaucuggacagagcggaugacagcucucucagguccaagaaacuguaucuuuacuauacccaaaugggccgauguauguacaguggucgcgugaucgacuuggaucagcugaacacagacaaguacgauauugaccauaucuauccccggagcuuaaccaaagaugacucuuuugauaaccucguucugugcgaaagacaggagaaugcuaagaaguccgacaacuacccgauugauccugacauccagaaugccaggaaacccuucuggacuuuucuuaaggaucaaaaccugauaucaagucguaaauaugaacgccuaacacgggugcucccacuggaggcagacgauuugacgggguucaucgccagacagcuggucgagaccaaucagagcgugaaggcuguaacuacauuacucaggcgacuguacccuggcguggacguugucuuugugaaagccgaaaacgugaccgacuuccggcacgauaaugacuuuauuaagguccgcucgcuuaaccaucaccaccaugcaaaggaugcuuaucugaauaucguugugggaaacguguaccacgagaaauucacaagaaauuucaggaaguuuuugaaaaagaacggcgccaaacggacuuauaaucucgcgcgaauguucgacuuugauguaauguccaccaacgccaaggacgggaaggcuugggauauuaaaacgucuaugaauaucgucaagaaaaugauggcaagcaacgacgugagaguuaccaagcgccugauggaacagaaaggagcccuaucagaugcuacaguguacaaggccagugucgcagguaaagcgaagggcggggccuacauaggaaugaagacuaaagacuccguguucucugauguuagcaaguauggcgguaggaccuccauuaaaaacgcuuacucaaucgugguagaguauacagggaagaaaaaugaaaucauuaaggagauagucccccugccaguguaccuuaucaaccguaauaagacugaccaagagcucauucauuauaucgugagcauuaucccccaggccaaaaacgucaguauaaucuacaagaaacuguguauuaaucaguugguuaaggugaacggcuuuuauuacuaccugggaggcaaaaccaauaacuauuucuggaucgauucugcaauucagguagugaucgcugacgaauggauaccuuacuuaaagguccucgagaaguuugacgugaugcggaaacaaaauaaggaacugaaaguugggacgguguccacaagcauucagaaccagggaaagaaagucgugaucaagauccuugaggaaagaaauguugaguucuuuucguaucuggugggcaaguugcacucaucuauuuacaguaaaaugaaggguaacaaagccggggagcucgcaaccaagucccuggaaaucuucgucaauaugagccuagagaaccaaugcauauaucugauggaacuucucaaucuguugacuaacaaaaaggccccagauguaaaaccguuaggaauuacagcuucuaggggcaccaucgguagcaagguguccaaccaggacgaguuuaagauuaucaaugagucaauaacuggccuguacaguaacgaaguuaccauuguguga

SEQ ID NO: 3288 - RNA, 4200 nt, Artificial Sequence
  Cas9 variant
augaaccugagaaauaccacagacgaguacaacaucggccucgauauggggacuaauagcgugggaugggccgucacggacaaggcuggugcaauugcccacuucaagggcaagcccacccuuggguccaggcuguuugaugcggcucagacagccgcaggagcccggauacaucgcucucaacgacguagauauguuaggcggcgcuggagauuggacuuacugcagucacuauuccaggaugaagugaguaaaguagacagcgaguuuuucugcaggcuccggcagucccgccuguacgugggcgaucgagaaaagggucacgcugacuauacuuggccuaucuuuaacgauucugacuucaaugaggucgauuacuauaaaagauuuccaaccauuuaccaucuuaggaaguggcugauggaaacagacgagaaggcagauauccgguugauuuaucucgccacccacaacaucgugaaacaucgugggaauuuccugcgcgagaacaauaagucgcugucaagcagagacgcuaacccggcccaagcgguuaaaagucucagguuagcacugaaugacugguguuccgaacgggauuacgagugcgccuggaagggagaagaggacgauggcgcuauagacgaggccauccuuaacguguuggcagauggcgaaaaagggcgaucugaccaggcuaaggagauugccaagcugacuggagucgauuguggugacgcgaaacagagcaagcagugcaaugaagccaucgcaaaagcuauugugggccuaaagguagagaugaaaaacaucuuuggggaguuccccgccgaaaagacauccuacauauaucucucaagugaugaggacguugaagcugugcgcgagagcuguccugaugacucuggagaacuguuucaagcccuuugcaaacuguacuccgcauauauuuugcaggagcuccugucauacgccgacccaagcggccagaccaucagugcuaauauggucgcgaaguauaagcaguacgguagagauuuaaggcugcucaaagaacuuacgcggacuuaugcaccccaaaaguacgaccuguucuuucgcggggagaccuacgccggaucuuccgauuaugugguggacgaggcuagaggcuacacaagguauaacuugggcacuaccaaagccaacuacgaugacuuccaaaagagcgucaaagaacuauucaaggggacagaugcacugcaggacgagcguuaucaagaaaugaugguugccuuuggagagcagaaguuccuccggcgacugaaaaccucggauaaugguucuauuuacuaucagcuucaccuggaagaguugcacacgauccucgagaaccagggcaagcauuacccuuuucuguuauccgaagaggacaaaaucgaaucacuggugaguuucaggauuccauacuauguagggccccuaacuagaaagaaugcugccauaggacacgauggcaaagagcgcuuugcauggagcucccggaaggacgguauggagcaugcggugaucacaccuuggaacugggaagagauuaucgauagagacaagucugcugaagacuucauaaugaggaugaccggggauuguacuuaccuccaaggcgagccaguccugccgaaaugcagccuuuuguaugaagaguuuugugcccugaaugaguucaacggagcacacuggacaguggacggcgaugacgaacgccgauuugaugccgcucagcgggagcguauuaugugcgaccucuucagaaggacccgcucaguuacguacaauaaggugagugauuggcuggaacggaaauauaacuuuaccggggccagagucaggggaggucagggcgagcacggguucgaauccaaacuuggaagcuacaucuuuuucuguaaggacguguucaagacagauggccuggacgaggcagauuauacuaugaucgagcagauuaucuuguggucuacccucuuugaagaccgagauauucugaagcgcaaaauagaggaggcuuacgguggggaccgguuaacaucagaacaaaucaagguaauuugcaaaaagagauucacuggcuggggaaggcugaguaaacgucuacucaccgacaucaagguuaauacagauaccggccgcaaaagcaucauggacgugcugcgggaagggaaccccaauaacggacagagauccaggacuauggucuuuauggaggugcuucgagaugaggacuuggguuuccagaaggccauugauggccugaaucgggacuacuuucgcgaacauaacaaugggcucauggaugucaacgaccugccuggaucuccagcgauaagaaggucgaucaaccaggccgugcggauuguugaugagaucgcuagcauugcacgaaaggaacccacgaauaucuucauagaggugacaagagaggaagacgauccucgcaaaaagggcaaaaggaccaagcgucgguaugacgccaucaaauccgcuuuagagaaguuuaagaaagacgauccaucacuguggaaggaacuuugcgagaaagcccccggugacauggaugaaagauugagucucuacuucaugcaaagggggaaguguauguauucuggccgcccgauuaaaaucgaggagcugcacacuggaaaguacgaaguagaccauauuaucccucgaagcuauauaaaggaugacuccuuugagaacaaaguccuaguguacagagaagagaaucagcacaagaccgaugcacugcucauugacucaagcauccggcagaaaaugggcggguauuggaggaugcugcaugaugcgaaacuuguuggagacaagaaguuccgcaacuuguuucguaaucacauugaugacaaggccaugaaaggcuucguggcuagacagaucgucgaaacaucucaaauggugaagcugguacagaccuuauuugaggcccgguaccccaacacuaggauagugccaguuaaagcagguaucucccacgaucuccgcgaggcugccgggcuggucaagugccgagaagcaaaugacuuccaucacgcccaugacgcuuuccuugcguguagaauuggacuguuuauccagaaacggcacccuaguguguacgauaaccccauuggcuuggccaggaucaugcgcgacuaugcaagaaugcaagcuagggaguacaagaaaagccacugccucgcccauacacaggguuucauagugaauagcuuucuguccucaggcuucgaugaagagacgggggaaauuuuuaaggacgauugggacgccaaggcugaggucgagggaauccggcguguucuaaacugucgccagugcuucaucagucgaaugccaguggaaggcgauaccagauaugggggaagguacuggggcgagacuauuuauagccccaaagguaagcacaaacaugaaaucccucugaagcaggggcucgacccaaaucuguacggaggcuauucggaucuuuuguacuccuacuuucugauuuaugaggcaucugacgugagcucaggugagcggguauuacgcuucauaggcaucccgacaaguauugccgcgagaauggcuaaccagaaaaggcucgaagaguacgucucccggcuggcccuucaggaaaaucuggagcacgugcgaaugguuagaaagaucaugaagaaacagcuaauugaaguggauaacugucgccuccuggucaccgcagccgacgcugugacaaaugcaacugaguuggccuuuucucuggaugagaugaagaucauaucuaccugcgcgaaauguaucaacggggcugaccccuccgccauugacaagaucggaaacgcacaggauucauucuuugacaauuuaaaaaggcggggcagcgaucguugcgcccuccuguucagucaacuuaagcuggacaaguugucucagaacuucuauaugauuuccagcgaugacaaaucgaagauccucauaucaauucuggauagaaucagggcuaaaucuaauaguguugaccuaucccugguagggggagccaagcaugcagcucagaugaaauuugauuucaacgccaaacuuaauaacccugcgagcucuuuugugcucaucgaccagagcgucacgggcauguucgaacgccggacccgaauuggucuguga

SEQ ID NO: 3289 - RNA, 4203 nt, Artificial Sequence
  Cas9 variant
augaaccugagaaaugccaccggcgacuacagcaucgggcucgaucuuggaacaaacuccguggguugggcugucacugacucuaauggcucaauggcacacuucaaggggaaacccacgcugggaaguagguuguuugaugccgcggagaccgcugccggcgcacggcagcaucgcggucaacgacguagauauguuaggcggcgcuggagauuagaccugcuacaggggcuauuccaggaugaagugaacaagguagacagcgaguuuuucauuaggcugcggcagucccgccuucacguggaagaucgagccgagggacaugcuggcuacagauggccucuguuuaaugacacagauuucacugaaaaagacuauuacaagagguuuccaaccauauaucacuugcggaaauggcucauggagacagaugagaaggcagacauccgucugauuuaccuggccgcucauaacaucgucaagcaccgcggcaauuuccucagagaagauaacaaaaauuuaucuucgcacaacgccaauccggcggaggcagugaggucacugcggcaagcccuugacgacuggugcgcugaacgaggguauguuugugccuggaccagcguggaugacuuggcagaggcugauagucauauucuggacauccuaacuaacuccaaggagcgcagagccgaucaggcgaaagaacucgccaagcuguuuggagucgacugcggugauacaaaacagucuaagagcuguaauuccgcacuugcuaaggccgugguaggccugaaaaccgaguugaaggacguuuucggggaauuuugcgcugagaaaacggccauacaccucucaagugaugacgauguggaagcaaucagggacgccauucccgacgauagcggagagcuguuccaggucuuaugugcuguguacucugcguacgugcugcaagagcuccuuuccuaugcaccuggccagacuaucucagccaacauggucgcuaaguacgaccaguaugguaaagaucugaaguugcucaaaaaucuggcccggaccuacguuagccgcgaaaacuaugacgcauuuuucagagggcagacauacgaggauaguaacgacuauaauguggauaaggcccaaggauacacuagguacaaccucggcaccacaaaggcuucuuaugacgauuucaaaaaguccguagaaaaacuguuuaagggcacccaggccgagcaggacaaacguuaccaagggaugaugaagcgguucgcagaagagaaguuucuucgaagacugaaaacgagcgauaauggaucgauuuauuaccaguugcaucucgaggaacugagggcgaucuuaaagaaccaggguaaacaccacccauuccugcuagaggaagagaagaaaauagaaucucucguguccuuucgcauucccuauuacgucggcccucugucaaguaagaaugcuagccuugaccauaaggggaaacagcgguucgccugguccgagagaaggccaggaaugaaggauacugugaucacacccuggaacugggaccaaauuaucgacugcgaucagucugcagagaaauuuaucuugcgcaugaccggcgacuguacuuaucugcagggugaaccuguucucccaaagugcagccugcuuuacgaggaauacugugugcugaaugaguugaacggggcccgauggacaauugauggcgacgauuggcggcguuucgacgucgcucagagagagggaauacuccacgaucuguuuaggaaaacccgcucaguggccuauaauaagguagcagacugguuagaacgggaggaaaacugggcuaaugcccauguuagaggcgggcaaggagagaacaguuucgaauccaagcuggguagcuacaucuuuuucugcaaagauguguuuaagacggcggcccuagacgaggcugauuauccgaugauugagcagaucauacucuggaauacccuguucgaagacagggcaauucuuaaacgaaagaucgagcaggccuacggcgaacaccaugggggaaaauugacagaugagcagaucaaggucauuuguaaaaagcgcuucacuggcuggggucggcugucuagaaagcuccugaccgggaucaaaguggacgcugacacaggcagggucucaauuauggauguguuacgugaaggaaaccccaaugagggccaacgcagucggacuaugguucugauggaggugcuuagagacgaagauuugggguuucagaagaaaauagacgauuucaacaaggccuauuuugcaggacagggugagggccucaugagcguaaacgaccugccuggguccccagcgaucaggcgaucuauuaaucaggccauccggaucgucgaugaaauugcuucgauagccggaaaagcacccagcaacguguucaucgagguuacccgcgaagaggacgauccuagaaagaagggcaggcggacaaaucgaagauacgaggacauuaaaaacgcucuagaaaauuuuaagaccgaggaucaagaacugugguccgagcuccuggguaaagccccaaacgaccuugacgagcgcuugucacuguauuucaugcagagggggaagugcauguacaguggccgucccaucaaauuagaagaacuccacacuggaaaguacgaaguggaucacauuaucccgcggucuuauauaaaggacgauagcuuugagaauaaaguccuggugugcagagaagagaaccagaggaagacgaaugagaugcuuaucgacccugcaauucgccgaagaaugggcgauuacuggcggaugcugcauaaagccaaguugaucggggacaaaaaguucaacaaucucuuuaugagggaucgcauugacgauaagacacugaaaggauucguagcucgucagcuaguggaaaccucccaaucaguuaagcugguccagacucuccuggaggugagauaucccaacaccaaaaucgugccagucaaggcgaauauaagccacgaccuucgggaagccgcagauuugguuaaauguagggaggcuaacgacuuucaucacgcccacgaugccuaccuggcuugccgcgugggcuuauucauucagaagcgacauccuucuguguaugcaaaucccaucggucucuccagaguaaugcgggacuacgccaggaaacaagcgggggaauuuaacaagacacacaguauggcucauaccaagggauucauugucaacagcuucaugacuucugaguuugacaaagagacaggcgaaaucuucugggaugccgaggcagccguggaagacauacgcagaguucugaauuauaggcaguguuuuaucucccggaugccaguggaggauacgggugcuuucugggaccagaccauuuacucaccccguaguaacaagcgccuugaacugccucuaaaagaugaccucgauccaaauaaguacggcagcuauucgcgagagcaguuugcauacuucuuuaucuaugaggccagagacgcgaaaaaguccaagacuguccugagguucgcucaagugccgguucgggugacaucugccauugcacgcgauagcucaaaauuggacgaauacgccagugggcuggcuguacaggagggauuagaauuuaccaagaucauaagaaggcggauucucaaaaagcagcugcuugagcugaacggcgaucgauuggucaucacaggggccaaagaggugagaaaugcaacugaguucgcuuuuacccucgaggaaacggcccugguggcgaugugcuccgagaucgcccgcgaaggaguccccucugagauugcaagcgacguucaguccaucucaagccaacuaagugaucuguuccuugcucucauugagaggggccugaccauaggugugcgguugcacgggcagcugaaguuaggacaguaucuccgucaauucgaagacgccgcucugagagacaaggcaaaaguaaucauuggcaucauuucuaucacaaacggugccacuaauacccuugaucuguccagcuugaacggcucgaagaauguggggcaggucaggauaacacauaacaaacuccugaaugacaagucaacuucuuacgugcuaaucgaucagaguguuaccggaauguuugagcgccggacgcgaauuggccuguga

SEQ ID NO: 3290 - RNA, 4203 nt, Artificial Sequence
  Cas9 variant
augaagaccaucacagaggacuacauucugggccucgauauagggacuaacagcugcggaugggccgugauggacaaaaagaauagacuucugagguugcgggguaaacgcgcuaucggcucccacuuauucgaagaggggcauucugcagccgaucgacguucauuuagaacgaccaggcggcgccugaagagaaggaaauggcggcuacgccuccuggaagaguucuuugcggaacccauggcuaaggucgacccugccuucuuuguucgacuucaccagaguugggugagcccacuggauaaggacaggaaaaaguaucaugcaauuguauucccgacagccaaagaggaucacgaguuuuaccaugacuaucccacuaucuaccacuugagagaugcucucaugcgggaagaccgucaauucgaucugcgcgagauuuuucuggcaauccaccauauagugaaguauagaggaaacuuccuccaggacaccccugucaauuccuuuguggccucuaaaaucgauguugcuucguucuuaacaaacgugaaucaggccuacgcggacaaguauggcgaggagcagaacuuuauugagcugaaugaaaacaaugcagccgcuaucgaggccgucauuagggguaaggacaaagauaagaccacuaaacaacuugacaaggcgaaaaagaucacaaaauugcugcagucaagcaccaacaaguacgaaaagaaugugacgcggcagauagcuaacgccauuaucggguacaaaacucaguucgagaccauucuaggaaaggauaucgacaaaaaugauaaggcggacugggaguucaaacucagugauggcgacgccgaugacaagcuggaaaaccuucugccagaguuugaugacaaugaccaauauaucguagcagaaauuaagaaauuguucggcuccauagcucucucucagaucguuuacgagaacaugacacugagccaguccaugaaguguaaauauaaggaucacggggaagacuacgauuuacugaaacaguauauugccacucucucagaccauagucaagugcgaaaacuucuguuggcuuacgaucuauaugucaacaaucgccacggaagacugcucgaggccaagaaagaauuuaagcaggacaaagcacugacccaggaugaguucuacaagaucgugaaagagaaccuugacgauagccaacuggcccagaagauauugcagaagauugacgaagguaaauuuaugcccaagcagagggugaauaaaaacggcuacaucccuuaucaacuccaccagaucgagcuggaucagauuaucgcuaaucagucuaaguacuauccauucuuagcggaagagaaccccgucaaagaacaucggaagcaagcaccuuacaaacuggacgagcuaguucgcuuuagagugccauauuacguagggccgcucauuucccccgaugacaagaggaaggacgagcagcagaauaaaaaccacgaaauguucaaguuugccuggaugaaacguaaggaugacaauggagcuauaacaccuuggaacuucgcccagaaaguggaucgggagaccucagcaaaucgauuuaucaagagaaugacggucaaggacacuuaucugauuggcgaagaugugcuuccagccaggagcuugcuguaccaaaaauucgagguucucaacgagcugaauaacauccgcgugaaugguaagcggcuugaacccaaauuuaagcagaaagucuucaacgagcuguucaagcagaagaacaaagugacaaagaaggcuuuuaaggaguucaucuugcagaauaccgggaugaaaacugccgaaauugacggacucgcagauccuacaaaguuuaacaguucucuguccagcuacuaucauuuaaagucgaccaaaguauucgacaagcaacuggaugacccacaguaccaggcggauuuugagaaaauaaucgaauauucuuccauuuucgaggacgcugaaaucuaccaagagaagcuacacaaagaaauuaaguggcucacgcccgcccaguuuaaagcaaucgccaauuggagacugcagggcuggggcaggcuuucacgcaaguugcugguugagcucaaggggaaaggaggugaaaacauaaucuaucagcuguggaccacacaaaagaauuucaugcagauugugaacgagccggaguugaaaaaggcuaucgucaaagaaaaucaucaggccacugaggaaaagggcauugagaagauccuggaugacaguuuuaccagcccugcaaacaaaaaggcuauacgacaggugauuaaagucguggacgauguugugaaggccgcagggggcaaaaagcccgcccaauucgcuaucgaauuuacacgggagccaaaguggaauccucaccuuuccaacauucguggaacuaaauugcuccagguauacgaggacaccgcaaagaaacuggucgaucagucucuaacagacagccugagagaaaauaugaccaacaggaaucuccugaaggaugaguauuuccuuuacuuuauccagggugggcgcgacgccuacacuggcaaaaagauagauaucgacgauauucccaagaaauaucaaaucgaccacauuuugccacagucauucaucacggaugacagucuggacaaccggguguuaacagaaauagagauuaaucagaagaaaggaaagaaauacgcuucccaucucuucgcccccaagccugcauuuggccugaaccaaagcaucucugagauguggaagaccuggcagaaagcggggcuuaucucacagagaaagcugaacaauuuacucuucgauccagaccugguuaaagauaagcagaaaaagggauuuauuaacaggcagcuaguggaaaccagucaaaucauuaaacuggucagcauaauccuccaggacaaguucccggauacugagauuaucacagugaaggccgguuauaauaccgcucugcgaaaagaacuuaaguuguacaaaucccgcgaggccaacgacuaucaccaugcaauugaugcuuaccugacugccaucugcgacaacuuuuuauaucagguauaccccaauuuccggccauuuuucguguacggccaauuuaagaaauucucucaggauacagacaagcagaagaaagcaguuaaguauuacgggcucaaaaauuuucugcuuccucugcuagaugacucgacgggagaugaagucauggugaaccacaccaagcacguggucuuccauaaacagagagacauauucaauaggcucauccaagccuauaacuacaaguauaugcugguuagccgugagacuacaaccgaaaauuccaacauguuuaauaugacaauuuacccccgcggcgaacgggacagaaagaaaacuaggaaguugaucccuaaagguaaggaucuggacccagcuauuuaugggggcuacucaggaaacaccgaugcguacauggugaucgugaaaauagagaagacgaaggaaaccuuauauaaaguagucggcgugcccaugcgagcccucgcaagucugaagaaagcucagaaggaggggaauuacgaccaggaacuuaacaaaguucuggagccguugauuauguucaacaagaauggaaaaucuaaggccgguaucaagggcuuuacaguggucaaagaucacgugcauuucaagcagguugugaucgacggggauagcaaauuuaugcucuauuccgcccaauaccgggcuaacgcaaagcagcugacucuaucacaggagaccaugaaaguagucacagacaauacugaugacauggaucaaaagaacgccgacaaggaucagcugcuucucaaugcguaugacgaaauucuggagaaaguggaccaguacuugccucuguucgauauaaacggauuucgccagggcuuacacgacgguagagcuaaguucgccgcacucaaaaccagcgaaaagaaauauacgcugaagaaugugcuuaacgggcugcaugauaauuuggucacaccaaaccucaagaauaucggcauuaaaacccccuuuggacugaugcaaucuuccaguggcaucacucuaagcccuaacgccaagcugguuuuccagucucccacagggcuuuuugagaaaagggugaagcucaccaaucuguga

SEQ ID NO: 3291 - RNA, 4203 nt, Artificial Sequence
  Cas9 variant
augggcaagcagaaauucaacgacuacuaucugggguuugauaucggaaccaauagcgccgguugggcugugacagaccuccaauacaaacuucugagauucaacaaaaaggauauguggggcuccagguuguuugacgaggcacagacuucuaaagaacggcgcgucuaucgaaauucacguagaagguuagaucggcgcaagaagagacugaaacuacucgaggaacuguuccuugacgagauuaguaagauagauaacacguuuuucaaaaggcugaaggaaagcaauuuguacaacgaggacaaauccaucaaguuuaauuauccccucuucaacgauaaggacuacaccgauauugacuuuuauaaugaguacaaaacaaucuaccaucugcggaaggaucugauuuucgaagacaaaaaguuugacauccgccucguuuucauagccuuacaccacauccugaaauaucgagggcauuuuauuuucgagggacagucuuucgaagagaucaagucguuugauucaauuuucacucagcuuagcaguuacuuuuuggagaacuucgacuuuaauaucgauguguccauaaaagaaaagcuggaggaaauuauccuaucugacaacaccaagagcauuaaaaagacagaguucaaaaagaucuuuuccgauaauaaaguacucucagugcugaacauggcgaucggcaguaaggucagccuuaaggacguguucaauaacgaggaacugaaagagcaaaagauuucuuuuuccgaaauagauuaugagaacgaaaagagagacgaguucuaccaguugcucggugaagauaucuuucugauugacuuagcuaagaaaaucuaugauuucaugguucugaagaagauacucaaaaauaccgacucauuuagcgccaguaagguggcacuuuacugcgagcacaaaaaggaccuggaugacuugaaauauauuuucaagaaguaccuaacuaaagaggauuacuucaaguuuuucaggucuaacgucgaaaagaucaauuauccuuccuacaucgggcugaacaagauuaaaagcaagaaaaucauuaaggagaauaaguguucgauaucugacaucaacaaagaacucaagaauaaauaucugaaggauauuaaacuugaggccaaggacaaggaacuguuuaaccggaucuucaauaaauuggaugaguuuaaguuccucgagaaacugaaguccucagaaaacaguacagugccauaccagguacaugagaucgaacugaaaaagauucuggacaaucagcguaaguauuacccguuucuaaacgagaaaauagauggaaagagcguuuaugagaaaaucauucaacucuucgaauuuaagauccccuacuacauuggcccucugaauaccgacccaaacgugaaaggcaagaauacgugggucgugcgcaaggaugagaacaacaaaacucccaucaccccuuggaauuucgaacagaagguggacaugcagaaauccgcugaggaauuuauaaagagaaugacaaacaggugcacuuaucuuaaagcagaggaugucaucgccaaaaauucuuugcuguacgaggaguucauucuccugaacgaacuuaauaaaguuaccguggacaacgaaauccugcacccaacauugaagaccgagauuaucaaugaacucuuuaagacgacuguaaaagugacaaagaaaaaguucauagaguuccugaaaaagaagcaggcugucaacgacguggagagcauuaccgggaucggaguugaauuuaauuguaaauuacaagguuauaacacuuuccggaagauucugggcaaaaagaucgagaaugugaacgucaaaaauuuuguggaaaagugcauagagcuaaagugucucuacgggucagauaaaaagcuguucgaaaacgccaucggaaaaauuuaucgagaguacaauaucacagacgaggaauuuaacaagauuaaccgccuuaauuucaacaaaugggcgagauugaguaagaaguuucugaccgagaucuccuucgagaaaacggauggcaccaagagguuugaaagcguaauagaggcacuccggucuacaaauuauaaccugauggaauuacugucagacaaauucaaucuucagaguaagauugaugagaucaacggugaagacgauuuuagcaauaucgacauuaaagaguacguugauaaguuguacgugucccccucugucaagcgcucgaucauucagacuuauaaaauagccauggaaaucaagaaaauuaccaagaaagacccuaagaaaaucuucauugagauggcuaaggauaagggggagaaaggaaagacaacugagaaaagaaaggacaaaaucaagaagcucuacaaaaacauaaaggauacccugagcgacuauugcaauaaccuacaagaccugacacuccagguggaaaaauacgaugacaauaggcugcgucagaagaaacuuuucuuguauuuuaugcagaugggcaaguccauguacaccggccgguguaucgaucuggaagacuuauucaacaauaacgucuaugauauugaccacaucuacccacaaucaaaggugaaagaugacaguuuugauaauauuguucucguggagaaggaagagaaccaucgaaaaucuaacgagcugcuuaaggaagagauccagagcagaaugaauaacuacuggauauuccugagggaaaauaaauuuauuuccaaggagaaguauaaccgcuugacucggaaaaaggacuucacggaugaggaacucggggacuuuguagccagacagcuggucacaaccaggcagucaacuaaagagaucgcaaaguucuuugagaaaaucuucgaaaagaccacagugguuuacagcaaggcuucucuaguguccgaauuucgcgagaaguaugacauuauaaagguccgagaggugaaugaugcccaccaugcgcaagacgccuaccugaacaucguagugggaaauguuuucaacaccaaauuuacuaagaauuauuggaaauucacaaaggauauuaaacggcagaacgaagagaauccgaacgaaaagaaggguuacaaucuccguaaaaucuaugagagugacgucuucugcaacgauagcguggcauggguguacucuaaggaaaaucccaaauacaacacgauuaauaccgucaaggacaugguuuauagaaaaacugcuaacaucacaaggaugcugguggagggcaaggggcagcuuuuuaacuugaccauaaaggauaaaacacagcugaagaaaaaugugggaaacaucguagccaauacuccuauuuccuuaaagaaccgcaaacuccacuuaaauucagucgagaucgcuaagaaguacggcuauuucgacagucuuaacaaugccuacuuugugcuguucaaauaugaagagaaggguaaagaaaagauuggguuugauagcaucaccauagcauacaaagagcggcuaaagaaaaaccucgacauugaaaaguuccuggagaauaagggcuauaaaaacucgaaguugaucagaaaaaucuuuaagaaucaaaaaguucugauuaacggauacccauacuuacucaaguccuucaauaagcagucucagaucaaauuuaacaauuucaagauacuguaucuuaacgagaacaaucugaaauuugccaaggaugcuauuaaauucgaaaagaacaaugcgaacguggacuugaagaaacagaaguacaucgucagcuuucucaaaaagaaaaagcaaaaugagauuaacgaaacguaugaggaauguaucgauaggcugaaugacgaguucgacacccuauuccugaaacuuugcgauauacagaaaucaaguauuuacacaaacuauaagcuccaggacuuuuccucuaauaaaaagagcaucgagaucaaagauaaguucgacauuuuuaagucccuggauuuguacaaaaagucaaaacugaucaaggaguucuuaaacuauuacaaauacgaaaagaaugaccucgauuuuagccugauugacauagauaaaaaggcaaacuguauccaaaagcacuucacugaagaccuugugaaagauuuuguuauuguggacgagaguguaaccggccuguucgucaagaaagagcgauugaaguga

SEQ ID NO: 3292 - RNA, 4203 nt, Artificial Sequence
  Cas9 variant
augaagaccaucacagaggacuacauucugggccucgauauagggacuaacagcugcggaugggccgugauggacaaaaagaauagacuucugagguugcgggguaaacgcgcuaucggcucccacuuauucgaagaggggcauucugcagccgaucgacguucauuuagaacgaccaggcggcgccugaagagaaggaaauggcggcuacgccuccuggaagagauuuucgcggaacccauggcuaaggucgacccugccuuuuucguucgacuucaccagaguugggugagcccacuggauaaggaccggaaaaaguaucaugcaaucguauuuccgacagccaaagaggaucacgaguucuaccaugacuaucccacuauuuaccacuugagggaugcucucaugcgggaagaccgucaauuugaucugcgcgagaucuuccuggcaauacaccauaucgugaaguauagaggaaacuuucuccaggacaccccugucaauuccuucguggccucuaaaauugauguugcuucguuuuuaacaaacgugaaucaggccuacgcggacaaguauggcgaggaacagaacuucaucgagcugaaugaaaacaaugcagccgcuauugaggccgucaucagggguaaggacaaagauaagaccacuaaacaacuugacaaggcgaaaaagauaacaaaauugcugcagucaagcaccaacaaguacgaaaagaaugugacgcggcagauugcuaacgccaucauuggguacaaaacucaguuugagaccauccuaggaaaggauaucgacaaaaaugauaaggcggacugggaguucaaacucagugauggcgacgccgaugacaagcuggaaaaccuucugccagaguucgaugacaaugaccaauauauuguagcagaaauaaagaaauuguuuggcuccaucgcucucucucagauuguuuacgagaacaugacacugagccaguccaugaaguguaaauauaaggaucacggggacgauuaccauuuacugaaacaguauaucgccacucucucagaccacggacaagugcgaaaacuucuguuggcuuacgaucuauaugucaacaaucgccacgguagacugcucgaagccaagaaagaguucaagcaggacaaagcacugacccaggaugaauuuuacaagauagugagggagaaccuugacaauagucaacuggcccagaaaauuuugcagaagaucgaggaagagaaguucaugcccaaacagcgggugaacaagaauggcuuuaucccuuaccaacuccaucagauugaacuggaucagaucauugcuaaccagagcaaauauuacccauucuuagcggaggaaaaucccgucaaggagcaccgcaaacaagcaccuuauaagcuggacgagcuaguuagauuuagggugccauacuauguagggccgcucauaucucccgaugacaaacguaaggauaagcagcagaacaaaaaucaugaaauguucaaguuugccuggaugaaacggaaggacaacaauggagcuaucacaccuuggaacuucgcccagaaaguggaccgagagaccuccgcaaauagauuuauuaagaggaugacggucaaggauacuuaccugaucggcgaagacgugcuuccagcccgcucauugcuguaucaaaaauucgagguucucaacgagcugaauaacauccgggugaacgguaagagacuugaacccaaauuuaagcagaaagucuucaaugagcuguucaagcagaagaacaaagugacaaagaaggcuuuuaaggaguucauuuugcagaauaccgggaugaaaacugccgaaauagauggacucgcagacccuacaaaguuuaacagcagucugucuuccuacuaccacuuaaagagcaccaaaguauucgauaagcaacuggacgauccagaauaucaggcggacuuugagaaaaucauugaguacucgucuaucuucgaagaugcugagauuuaucaggaaaagcuacauaaagagaucaaguggcucauacccgcccaauuuaaagcaaucgccaauuggaggcugcagggcuggggccgccuuucccgaaaguugcugguugaacucaaggggaaaggaggugagaacauuaucuaccagcuguggacgacccagaagaauuucaugcaaauugugaacgagccggaauuaaagaaggcuaucgucaaagagaaucaccaggccacagaagagaagggcauagaaaagauucuggacgauucauuuacuagcccugcaaacaaaaaggcuaucagacaggugauuaaagucguggacgauguugugaaggccgcagggggaaagaagcccgcccaguucgcuaucgaguuuacccgugagccaaaguggaauccucaacuuagccacauaagaggcacaaaauugcuccagguauaugaagacacugcaaagaaacuggucgaccagucccuaaccgauucucugaaggagaacaugacaaauaggaaccuccugaaagacgaauacuuccuuuauuuuauccagugcggucgcgaugccuacaccgggaagaagauugacaucgcugauauucauaaaaaguaccaaaucgaccacauauugccccagagcuucauuacugaugacucacuggauaaucggguguuaacggagaucgagaucaaccagaaaaagcauaaaaaguaugccagucaccucuucgcaacaaagccagcguuuggccugaaccaauccauuagcgaaauguggaaaaccuggcagaaggccggacuuaucucucagagaaaacugaauaaccuacucuucgaccccgaucugguuaaggacaaacagaagaaaggcuuuauuaauaggcaauugguggagacuucacagauaaucaagcuggucaguauuauccuccaggacaaguucccugauaccgaaauuaucacagugaaagcuggguacaacaccgcccugcgaaaggagcuuaaauuguauaagagccgcgaagcaaaugacuaccaccaugcuauagaugccuaucugacugcaaucaacgacaacuuuuuauaccagguauauccaaauuuccggccguuuuucguguacggacaauuuaaaaaguucucccaggauacagacaagcagaaagaggccauuaaguacuauggucucaaaaauuuucuggagccccuucuggaugacucuacgggcgaugaaguuauggucaaccacaccaagcaugugguguuccacaaacagagagacaucuucaauaggcuaauucaggcuuacaacuauaaguacaugcucgucucgcgugagacuacaaccgaaaauagcaacauguuuaauaugacaaucuauccucgcggggagcgggauagaaagaaaacuaggaagcugauaccaaaaggaaaggacuuggaucccgcgauuuacggcgguuauuccgggaacaccgacgccuacaugguuaucgugaaaaucgaaaagacgaaggagacccuguacaaagugguaggcgucccuaugcgagcauuagcuucacucaagaaagcccaaaaggagggaaacuaugaccaggaacugaauaaagugcuugagccacugauuauguucaacaagaauggcaaaaguaaggccgggauaaagggauuuacaguugugaaagaucauguccacuucaaacaggugguuaucgacggugauucuaaauuuauguuguacagcgcucaauaucgggcaaacgccaagcagcucacucugucccaggaaaccaugaaagugguaacagacaauacugaugacauggaucaaaagaacgcggacaaggaucagcuacugcuuaaugcuuacgacgagauucucgaaaaagucgaucaguaucugcccuuguucgacaucaacggcuuucgccaggggcugcacgauggcagagccaaguucgcagccuuaaaaaccucagagaagaaauacacgcucaagaauauucugaacggacuucaugacaaucuggugacaccgaacuugaagaauaucgguauaaaaaccccuuuugggcucaugcaaaguucuuccggcaucacucugaguccaaacgcuaagcuaguguuccagagccccacaggacuguuugagaaaagggucaaacuuaccaaucucuga

SEQ ID NO: 3293 - RNA, 4203 nt, Artificial Sequence
  Cas9 variant
augaagaccauccugggccucgaccuugggacaaacagcauuggaugggcccuggugaaagagacugaaaauuccaacgagaagucugaaauaaucaaauugggugucagaguuaaucccuuaacgguggaugagaagaccaacuucgaagcuggcaggccucugucaacaaaugcagaccggacugccaaacgcagugcgcgacguaaccuacagagauacaagcucaggcggaagaaucugauugaucuucugaucaaacaccgcuugauugacaaggauaccccacucacagagaucgggaaaaacaccacucaucaaacacuggagcugagagcuaaggccgcaagggaacggauagagcucgaagacuuagcccgcguauuucuggcuaucaauaaaaagcgaggauauagaagcuccaggaaggugaacaaugaggaggaaggccaggucguggaugguauggcaguugccaaaaaguuguacgacgagaaccuuaccccggggcaguaugcuuacgaacugcuaucuaaaggaaagaaauaugugcccgauuucuaccggucggaccuccaggccgaguuugauucaauuugggaauaucaaaagcaguucuacgcggacauccuggaugacgagcuuuacaaugcacugaaaggccagggccagcaaaacagccguaagcgcuuuuuggccauuaagggggucuauacggcugagaauaaaggaaagagagacgaagugaaacuccagcacuacaaguggaggagugaggccaucacucagaaacuguccauagaagagguagcauauguuuuaguggaaauuaacaacgaucugaauaagucuagcgguuaccucggcgcuaucuccgaccggucaaaggagcuuuauuucaacaaagagaccgucggggaaaaucuguggaagcagauucaaaagaacccucauacaaguuugaagaaucagguguuuuaccgacaggauuaucuagacgaguucgaacaaaucugggagacucaggcccaguuucacccacagcugacccucgcgcugaaagaacaaauccgcgauguggucauuuucuaccagagaaaacuuaagagccagaaaggacuguugucuuuuugccaguucgaguccugggagauagaaaggaaggacgagaacggcaauguuauccucaacaaaacaacccaacugcccaagcggcagacggugggucgcagaguagccccuaaaucaagcccauuauuucaggaguucaagauuuggcagaauaucaacaaucuggagauagcaaagauuagugaugggaacucuaaaaauaagaaagagacugaagcucuauccgacgaugagaggaagcuccuguucgaagaacuuaacuugcguggaaaucugagccaaaaagaagugcuccagauccugggccuuaaggacaaagaguacaagacaaacuuucccgagggccuggaagggaaccggaccaaugccgcuuuguucaacaucuaucagcagauugccgagaaugaaggauacggugauuggacuaagaaaucggcacaagagaucaaggaggaacucaaagccgucuuuccucagauuggcauacaggcugacauccuggacuucaacgcggaguuagaugggaaggaauuugagaaucaagcaucuuaucagcuguggcaucuacucuacuccgccgaagaggacgauaaaauuaacgaagaggaccagaucaucuauggaaauucagcugugagucugaagaagaaacuuugugagaaguucggcuuuacaccagaauacgccaaauggauugcaaacguuagcuugcaggaugacuaugguaaucuguccaccaaggccaugcgaaaaauaaucccguaccucauugaugggaacgacuacucugaggcuugcgcccuggcaggcuauaaucacagcaacucauuaacgaaggaagagaaugauaacagagagaggcugaauaaacuugaauugcuccccaaaaacagucugcgcaacccuguggucgagaagauccuaaaucaaauggugaacguaguuaaucaggugauugaaaccuacggaaaaccagacgagguccggaucgaacuggcgagagagcucaagaaauccgcugaggaaagggccgagaugacaaagggcauaaacgaagcaacucgccgaaaugaggauaucaagaaacugauuaccaagaacuucgggauccccaauccuacaaagaacgacgugguccgguaucgucuuugggaagaguuggccccacuggcuuacaaggauguguuuacuggaagacagauuaaaaaggaggacuuauucagcucuaaaaucgacauagaacacauuauccccaaggcccuccuguuugaugacucauucaguaauaagacccuugcauuuagggagacaaaccugaaaaaggcugaucgcaccgccuaugguuucauugaaagcgacuacaaugcgacuuuggaugacuauauccagcggguugagacgcucuacaacaaugccaaaggcacaauauccaaggggaaaagaaacaagcugcuaauggcucaaaagaaucugccggauggauucaucgaaagggaccuccgaaacucucaguacauugccaaaaaggcaaaaucgaugaucgagaagguguuuaacgauguaaaugucaccagcggcuccauuacugaccgccugcgggaggauugggaccuuaucaacgugaugaaagaauugaauuucccuaaguauaaggcucuggguuuaaccgagauagaagagagauacgauauugggcaggagaaaacaaagaaaguugaagugaucaccgacuggacuaagaggaacgaccaucgucaccaugccauggaugcacucacagucgcguuuacgaccaaaucacacgugcaguaucugaauaaccuuaauacuauccacagucugaagggcgacgagguagaucuagaacucucuaagcuguacggauugaaaaacacaauuaccgaggugguuaauaagaaacgcaaguucauucccccaaugccuaacuuucgggaagaggccaaaaagcauaucgagacaauacuggucagcaucaagaauaaaaacaagguguauacuaaaaauauuaacaagaccaaaaaggaauccggcuaccacacgaaagagcaauuaacccccagagggcagcuccauaaggaaacaguguauggaaagucaaaaaggccaaugaauaagcccacuaaaaucaacaagaauuucagccuggagcaggcucaacuuauuaucaacguccaggaaaaagagcugguuuugcgacaccucgcccaguuugacaacaauccugcaguggcuuucgauaccaagacacugaagaaaaugccacuacugaagaacggugagccgcuuaaagaagugcucuguuuugaggaaauauucacuauccggaaggacauuacccccgaucugaaaaucgagaagguagucgacgaaaagauuaaagccaucuuggagcagcgcaagaaagauuuuggcgggaaugcaaaggaggccuucucugaccuggauaaaaacccuauaugguuaaauaaggaaaagggaauuugcaucaaaagagugacgaucacaggcguuuccaacgcugaggcgcuccaucaccaaaaggaccaccuggguagggaaauucuugacgauaaugggaacccaauacccgccgacuuugugaguaccggcaauaaccaucacgucgcaaucuacgaggaugagaaaggaaagcugcaggaaaaagugguuagcuuguacgaggcuguggcccgggccaaucagggccucccuguagucgacaaggggcugaacgaagaucuaggauggaaauuccuguucacuaugaagcagaaugagauguuuguguucccaaacgacgauuuugacgugaaugauauugaccuucucgaugaaaacaacgcuaagaucauuucucaacaucuguuccgaguccagaaauuggcaacaaagaauuauauguuuagacaccacuuagagaccaacguucaggaggugaaagaacugaaugacaucgccuacaaguccauacgcucaacugagccccucaaaaacaucaagaagguaaggauuaaucauaucggcaaaauugugcaggucggugaauauuga

SEQ ID NO: 3294 - RNA, 4209 nt, Artificial Sequence
  Cas9 variant
auggccaagaaagacuacaccaucggccuggauauugggacaaacagcgugggaugggcuauaaucgacgauaaucucaaacuucugaaaagaaacaugacuauuaaggguaauacggacaaaaaguccgucaagagggauuuguggggcucuuuacuguauucagggaacagugacaaaaccacaagcgcagccgaugcgcgguccaagcgcggacuacgacguagacucaggcggcgcaaauacagacuggacaggcuuaagcagaucuucucugagauuaucaaugauaaagcucccaacuuuuucgacaagcugaaugaaucguuuuugaacccuaaggauaaaaaguauggcaaauaccaaauauucgacacugagaaggaagagaaagauuauuaccggcgcuauccaaccaucuaccaccuccgaaaggaccugauugaaucaagcaaaaagcaggacaucagacugguuuaccucgccuuagcacauauucugaagaguagggguaauuuucuuuucgaggggaacaucgaugacuugaaaaaugauuuugccggaauauaugaggaagugguagagcugugcaugacaauuaacgcugaagacguggaucuagaguucgaggaagucgacaagcagucccucaauucuaucauuaaaaacgaggauaucagcgaaaucgagcagggccuggaaaauuuugcagacgagcacgugauuuucaaggagcaaaacaaaaagaagaacgaucuguuuuccaauuguugcaaaauaaucuguggccauaccguuaaggccaacaaauucgcuucagaacuugacagugaguuguuuauuagcuucaagucugaugacuacguggacgucaucgaugugauacaguccgggaaugaaaacauugccaaucuccuguuagcgugccggaaagcauaugacuacaucauguucaaccgucugguagaucucaauaucgacucaccggccaaacuuagcaguaacaugguuucucuguauaaucagcacgagaaggauuugaaggcuuacaagaaacuaauuaaggaauuuaacaaauucaagcgcuccaauggauguaaggaccuggagaugaucauucucacugccgaugacauagauagcuuuagaaagaagguggacaaaaaggaggguaaacugaacggcaucaauaagaaaauuacacaugaacaggcacuuaagaagcaacugaaagauaugaagaaaaucuuggaggacaagaacaccgaagcugaggauaaacagaucaaugacauucucaagaugauaacgucgaucgaagagagggucaacaagucuugcuuccugaaaaacuuacgguccacugacaaugccucaauucccaaccagauccagcgacaagagauggaagcgauucuggauaagcaggccaaauuuuauccuuuccuaaaugagcacaaggacgaacuccugcagcuuuugaguuuucgcaucccauacuacguggggccccuggugaacaaaaaguauagcagauucgcauggcucgucaggaaggagggacaaguucagaaaauaaccccuacaaauuuugauggcgugguagacaagcacaaaacugcugagaaguucauggaacggcugaucgguaaagauguguaccuuccaaacgagcgcguccugcccaaggccuccuugcucuaucaggaauacuguauuuuuaaugagcugaccaagguggcuuauaucgacucuacagggaaaaagaacaauuucagcucagaagagaaauuaaacauuuuugagaagcuguucaaaaccaagagagaaguuacgaaaacugaucuaugcaagugucucaauaacgugugcaagcugaaagagaaggucaaagaaacagagaucauaggaauuaaggccaaauucaaugcaaaguacaguaccuaucaugaccuuaagaaaaucaacggcauggaacaguugauugccgaugaggagggcaagccucugugugaagacaucauauccauccucacuauuuuugaggauaaagacaucaggcuggugcguuuaaaggaacugcuuugccaaaauaaagauuugauuaacaaguucagccucucugcugagaagcuggcgaaaguacuaucaacaaagcacuacaaaggguuuggaaacguuagugcaaagcugaucaaugguauacgggacaaaaacugcaagaccauucucgacuaccugaucgaagaugacaaggaggccuauuacggccgaaauaacccaaauagaaaccuuaugcaguuggugaaugauagcaggcuggcuuucaaagggcagaucgaccgcgagcagaacacgcauuuagaagaucucucccuggacgaguuucuugaugaccuguaugucucuccgucgauucggagaggaaucagguugaccauucgccucguggaugaacuggucgagauaaugggcuaccuacccaagaauaucgugauugagaugccucgagaagacggugagaaagggaagaucgccgauacacgguauagcaaacuggaaaagaugcucaagaaagacgcagcccuggaggaccuuuaccguguuuugaagacuuaugagaaaaacaagaaagcucuggccaaugaugcauuauaccucuacuuccugcaaaacggcagagacauguauaccggaaaggaaauuaaucuuuccgagcugcacucauacgauaucgaccacauaaucccaaaaaguuuuaaguaugaugacucucuagauaacaaggugcucacagcgaaaaagaugaauauggacaaaaggacuggcgcucuggaucauaacauuaucgaaaaccaguguggguucuggcgcguauugcugcagcaggacaagauuagcuuagagaaauacaccaaucucaugaagacagaauuuaccgaggccgauaaggcaggauucaucaugcggcaacuggucgaaacuagacagauaacgaaauuuguggccagguaucuugacaacaaguucaauggucugauuuccgaucccaacgacaaaguuaauaucuugcucccucgagcuucacugugccaccaguuucgcgagacauucggcuucuacaaggugcgggagcuaaacgacaugcaucacgcccaugaugcauaucugaaugcugucaucgccaacacccuuaauaaaaacgcguaccucagcgaccuguugaaguacggggccuauucuaaguacaaaaagaauggauuuaacaauuccaacggcauuauggauuauuucgguaauacucaguuuaacugucuguucgugguagaaagaaccuuagacaaaugcagggugaauauaguuaagcacccagagacagcuaguggggaauuuuacaacgagaccauccagaaaaacaaggucaauggcggaagcucuacucguucccucaagucaagugugaaagugcugcaaaacacagaacaguauggcggguucacgaaugucaacaaugcauacuuuauucuuuucgauuauaaggccaaaagcaagcugaaacgcaaguugaucggaguucccauuguggaccggcaaaaauuugagcaggauccggugaccuaccucgaggcuaaggguuucgacgaaccuaagcugguacagaaacuacugaaguacacucuucucgaguaugaagauggcaaaagaagguaccugacaggggucaccggaaagcgaugugaguuggugcgggccaaccaguuacugcucccccgcaauaugauggcacugcuucaccaucugcaagaguggcagaaacacgacuuuggcaucaaggaaaugacaaagguuaucaaaaacacuaauaacauagaggcgaaguucgauaaauuguucgaacauaugaugaaguuuauugacaaauauucggagccaccuaagaucguguccucuaagauuagcgaagaguaccacaaacuaagagagucacugugccaggaugacaauaagaucaaaauauaugccgaaauugguaaggcucuccugagucuuuuacaccuggucgacuccaaaucugccuguguguucaaguuuagcgggcucgagaucaacaggauccgguaccaguccauuaaugaaaagaaagagcccguuaucauauuccaaucauugagcggccugcgagaaaguagauauaaguacaaccaguga

SEQ ID NO: 3295 - RNA, 4209 nt, Artificial Sequence
  Cas9 variant
augaagcugagaaacgccaaagacuacagcaucggccucgauguggggaccggauccacagguugggcugucacuacgcuugacggcgaucuguucaccuuuaaucacaggcccacauuggggucucgguuauucgagucagcaaguacugcccaggaaacccgcgaggcgcgaggagcucguagaaggcugaagcggcgcagauggaggauuagccuacuccaagaacaguuugccgcagagauggaauccugcgacucuaacuucuuuauacggcugaaucagucgcgccuuuggcaggaggaucgaacagagcaaggcaaagguuaucuguucgggggaaagccuaucuuguguggcgcccagauuuuugcuaacgaacaggaguacuaucagcaauucccaaccaucuuucaucucagaaaauuccugguugaaugcucagaacagguggaccugaggcucauuuacuuagcacugcacaauaucguaaaguaucggggcaacuuucuuuaccaggauaauaagacuuugaacgugcguaauuucaaccuggacagccagauagccgauuuucuagaccaacuccagcuguggugugagaauaacgaucuuugcuuccaugaaaucgacgggacaaccacgcuggcuagucaguugaauacuuguuuccaccaacaguccaaccagcagaaaaaggauacccucaaaacauuuuucgccacuugcauugagaaugacaagaucgcgggagaacugaccaaagcauuacuggguuauaagacagacuuuaagauuaucuucaacauagagggcgaaaaagaugaguacaaggccaaauguaacgaggaagagaagauucucaaacuucaagaaaccaucgacgaugcuaaucagguccuguugcagucuauucuaaaccuguacagcgggaucaucguggagaagauucucaauaacacggccguuaaaaaugaauccgcacagugcacucugucagcuuaucauuguuacaguuaugcccuuuacagcaagcaacugcgcacauugaagaaacucgugagaaaguauaacccgcagagguacaaugagugcuuuaaccugucugcggaggaccccaaagccaagaaacaguuauguaccuaugcacgguacaaugcucagcacuccacugauuacgacgaguucaagaaguauauaaaagaucuguuugagaacacagacgccgucaaugaugcugccuaccaacagaugaagcaggacuucgaugaagagaaauuucuacgacgccagaagaccucagacaacggaguguauccuuaccaauuccaccucgaagagaugcagcugaucauugagaaucaggcacaacauuauccauuucuuacgaaaaucaagcccaaguuggaaagccugguaaccuucagaauaccuuacuauguuggcccacucacacagaaagguauucagaggaacgggcggaaguuugccuggaguaaacgcaauaaggacgcugagaaccagagaaucuaccccuggaacugggauucuaucauugacaaauccgcgagcgcagaagccuucauccugaggaugacuggaaagugcaccuaccuuuauggcgaggaugugcugccuaaggagucguugcucuaccaagaguucugcguccugaaugaauuaaacggcgcucguuggaauugugacggggaacggcgaaugccacugucuaacaaagauugcaaggccauuuauagacagcuauuucucaaaaagcagaaaguguccuacgcagacgugucaaauuaucugaaggcccagggacacauaaacaauagugucgcugguggccaaggggagcauggauucgaaagcacacuuuccucucaccacuuuuucaggaaauuguuuaacguugaugccgcaaaugaccugacugcgcagcagaucgagaccgcugagcagcucauucuguggggcacaaucuucgaagauaaggagaucuuugaacaaaagauuaaagagcgcuucggugacauguuuagcaaggaugaaauaaaaaccaucgcccggagaaaguucucaggguggggcaaauguaguaagcaguuacuguccggacuuacuguggagacgccgaggggccgcgagagcauuaucgacguauugcgaaacgggcaucccgaaaauggacggacacucguguuuaugcaggucauuaccgauaagaaacuggaguucgacaagaaaaucgaagaguacaacaaugaacaccuagcaaagacuaacgagucugugcuggacaccgccauaaugaguccugcuaucaaacgugguguuaaucaagcccuccauauugugggcgagaucagaaggauuacaaagcacgauccaaccugcaucuauauagaaacuacacgcgacgagaaggaugggaaacauaacacgcggaccucaagcagauacuccucucugaagaaaaaccuugaaacuuugaagucgauugacaaagcaaaugcucccgccaucaagcacagccuggaguuacucgagacauacaagaaacagaacauugaugacaagcuguuucuuuauuucacccagaauggaaaauguauguacuccggcaagucacuggauaucaacaauuugaguucuuaucagauagaccacgucaucccucaaagcuacauuacagauaacuccuucgacaauagggugcucguauaugcgucagaaaaccagcgaaaaagcgauucucugcuacuguccaguguuauccaggccaagcaggagccauuuuggacuagccucgaaaaagcuggucugauuucugagaagaagcauaauaaccuuaaacgcaaguccuugucagacgcacaaaucaaaggguucauaaaucggcagcugguggaaaccagucagauugucaagguguuaagagaugagcucagcaggauccugcccgacacgaaaaucauuccggucaaggccucgcuuucccacgacgugcguaucgcuugcaaccuguacaagucucgcaccgccaauagcuuucaucacgcacacgaugcgcuacucgccucaacaaugggccgguucguucagacuagauuuccugacauguaugagaaccccgugagguacguaaaaauucugcgagcuuacauagcccaaaguaaguugcagcauuccgcacagacccggaauuucgauucucgcagcuuuauggcucacuccuucuuuugugacuauucaaacgaaaacggagauacaaucuggaauagcgccagugagauugaaagacugaggcgggcauuaucuuacaaaaaccucuaucugacucgaagaccauucaucgacgccggccaguuuugggaucaaaccauuuacuccccucaugacaagaaaaagacgcccgauagccuuaucccacugaagaaaaauuuggacacacagaaguaugggggauacucggguaaagauuaugcucacuucuucauauacucaguccucaacaagcagggcgacguggaguaccgcuuugacgggguuccccuguauaucgcggccaauauuaacagggaugaccguggagcacuagcucaauacgccaaacagcugguggaacaugagaaugucccuaacgccaagcggaagaccaaagaucuuguguuccagagaaucgagagggcuugcguaccaaaguaucagcucauuuguaucucucaaugcaguggcgacuccgaucgcagcgugucugacuacuauuacauaacugguaaaaaggaaguucgaaaugcacugcaguuggccuuuccgaugcaccuguauggggcgauuaacgcuaucgaggauaaaaaggaauuagacgauagcgcccucgaggaacuggucguguacauccuuagaaaugcaccccggauugccccugacguguucaggcgccugaacuugacagagaagcucgcugauugucuggacauaccagaucguaucgagcuacaaaauuccauuuacggccuguuuaaccuuaucaaugcagaaucaaacgucguuaaucuccagauuuucggaggcgccaaaaccgcgggggugaagcugaucaacuugaacaguuuacugaaugaccccgcuacuaccgugacauuuauagaccagagcguaacgggaauguucgagagaaaagaaaccaucggcauuucuuga

SEQ ID NO: 3296 - RNA, 4209 nt, Artificial Sequence
  Cas9 variant
augggcaagcaggaguucaacgacuacuaucugggguuugauaucggaaccaauagcguggguugggccgucacagaccaacaguacaaacuccuuagauucaacaagaaagauauguggggcuccaggcuguuugaagaggcuaagacugcaaaagaacggcgcguuuaucgaaauucucguagaagguuggaccggcgcaagagaagguuaaagcugcuagaggaacucuuccuggaugagauucuuaaaguggacucaacguuuuucaagcggcuggaggaaaguaacuuguacaaugaggauaaaagcauaaaguuuaacuauccccucuucaaugacaaagauuacaccgacaucgauuuuuauaaggaauacaagacaauuuaccaucugcgcaaagcccugguauucgaggaccgaaaguuugauaucagacucuuauucauugcgcugcaccacauccuuaaauauagggggcauuuuauauucgagggacaguccuucgaagacaucaagucuuuugacuacauuuucacugagauccaggauuggauuuuggaaaacuuugagaucaauauagacauuaaccugaaagaaaagcuagaggagaucauucucucgaauaacaccaaaucaaucaagaagaucgaguucaaaaagauuuuuagcgauaaucggauacuggcuauccuuaacaugggcguggguugcaaagucgaccugaaggauguguucaauaacgaggaauugaaagaccaaaagauuaguuuuacagagaucgauuaugaaaacgagaagcgugacgaguucuaccagcuccugggggaaggaauauuuauuguugauuuagccaaaaagaucuaugacuucauggugcugaaaaagauccucaaaaauuccgauuacuuuucugagagcaaggucgcacuuuaugaggaacacaaggaagaccugaaccgcuugaaauacauuuucaagaaauaccuaaaguccucagacuauuacaaauuuuucagaaguaauagcgagaagaccaacuauccuucuuacaucggccugaauaagauuaaaacuaagaggcucauagagaacaauaaauguuccaucucagauauuaacaaggaacugaaaaauaaguaucuuaaagacauccagguggaggccgaagaugaggagcuguucaaccggaucuugcauaagauuaaugaaaacaaguuucucgagaaacuaaagagcagugaaaauucuacaguaccauaccagguucacgagauagaauuaaagaagauccuggacaaccaacgaaaauaucacuccuuccuaaaugaaaagagcgauggcaugacccucugcgagaagauuaucaaacuguuugaguuccgcauuccguacuacguggggccccuuaacacgaacccuaauaugaacaagaaaaauaagaacacuugggucgugaaaaaggaagaaaauucgaagucuuccaucaccccauggaacuuugagaaaaagguggacgaacagaaaucagcugaggaguucauaaagagaaugacaaauagguguacuuauuugcggggagaagaugucauccccaaaaacagucugcucuacgaggaauuuguucugcuuaaugagcugaacaaggugaccguagacaaugaauugcuccauccuacacugaagaacgagauuaucgaugaguuauucaaaaccacggugaaggucacuaaaaagaaaauuacagaauuucugaagaaaaagcaggcaaucagcgacguggaguccauaaccgguauugauguugaguucaauggcaagcuacagggguauaacacuuuucgcaaaauccucggagaaaagauugagaaucugaacaucaaaaaguucguggaaagaugcauagagcuuaaauguuuguacggcucugacaagaagcuguuuaaaaacgccgucgguaagcucuauaaagaauacaaugugacagaugaggaguucaccaagaucaacaaacugaauuucaacaagugggggagguuaagcaaggaauuucugacgggcauucguuucgagaaaaccgacggaacagaacgguuugagucaguaaucgcugcccuucgaaguacuaauuauaacuugauggaacuccuguccgacaaguucaaucuacaaagcaaaauugaugagaucaacggcgaagacgauuuuucuaauauagacauuaaggaguacguuaacgagcuguacgugucaccaagugucaaaagaagcaucauccagaccuauaagauugcgauggaaaucaagaaaauuacagggaagaaucccaaaaagguguucauagagauggcaaaaggagguggcgaaaaggggaagaggacugagcgccggaaagauaagaucaaagaacucuacaagaacaugaaagacucccugucugauuauugcaauaaccuucaggacuugucgagccaagucgagaaguacgaugacaauagacugaggcagaaaaaguuauuucucuauuucaugcagaugggaaaguccauguacaccggcaacgauauugaccugucagagcuuuuuaacaauaacaucuaugauauugaccacaucuacccucagaguaaagugaaggacgauucuuucgacaauauaguucugguggaaaaacaagagaaccauagcaaguccaaugaauugcucaaaccagagauccagucaaagaugaacaauuacuggauuuuucugcgcgagaacaaguucaucagcaaagaaaaguauaaucgacuaacacggaaaaagaacuucaccgaugaggaacugggugacuuuguagcccgucagcucgucacuacgagacagucuacaaaagagguggcuaagcuguucgaaaagauuuuugaugggaccgagguuguguacuccaaagccagucuugucagcgacuucagggagcgcuuugauaucauaaaggugcgggaaguaaaugacgcacaccacgcucaagaugccuauuugaacauugugguuggcaaugucuucaacacuaaauuuaccaagaauuacuggaaauucaucaaggagaacaauagaaagaacgaagagaacccgaauaaaaaggaaggauauaacuuuaaaaauaucuacgagucugacguguucaggaacgaggauguggcgugggucuuuuccaaggaaaauaaagagauuaacacaauaaagaccguuaauaaaaugguguaucgaaagacugugaacaucacagaaaugcugguagagggcaaggggcaguuauucaaucucacgauuaaagaccgcacccagcugaagaaaaaggucggaaacaucguggccaauauucccaaaucacuuaagaaccggaauacuaagcugaaaagugacgaacuagcaaagaaauacgguuacuuugauagccucaacaauucguauuucguucuguucaaguacguggagaaagagaaggaaaagaucggcuuugacgggauaacaaucgucgauaaagagaaguugaaaaagaacuccgacauugaaagauuccuggagaacaaaggaaauaagaacgcuaaguuaaucaggaaaauuuuuaagaaucagaaagugcucaucgauggcuauccuuaccugcuuaagucuuguaacaaagacaaggccauacguuucgauaauuuuaaaagccuguauuuggacgagaacgaucucaaguucacccgcgacgcuauuaaguuugagaaaaauaacgccgauaucgaccugaagaaacaaaaguacaucauuucauuccugaaaaagaagaaacagaaugaaaucaacgaaacauaugaggaaugcauagagcggcugaauaacgaguuugauacucuuuuccucaaucugugugacauucagaagaguccaaucuacaaaaacuacaaguugcccgacuuuauuuccaaaaagaauguuguggaaguaaaggauaaauucgaggucuuuaagaaccuggaauuauauaacaaaucuaagcucaucaaaaauuuccugaacuacuucaaguaugacaauaacaaacuugaucugauagcaauugguaucgacagcaaagccaauugcauccagaagcauuuuaccgaggauuugauuaaagacuucgugaucguggaugaauccgucacggggcucuuugcuaagaaagagagacuggaguga

SEQ ID NO: 3297 - RNA, 4209 nt, Artificial Sequence
  Cas9 variant
augaccuacagaaacuaucacaucggccuggacauugggacaagcuccgugggauucgccgucagguacgauaauggugagcucguucauaagaaaggcucuaaccuugugggggcucggcuguuuaaggaaggagagacugcagaagaacgccgauugaaucguggcgccagaaggcgguauaaccgcagaaaauggagguuaaaucugcuaaaccagauauucaagccccucaucgaaguaaaugacccuacguuuuucaaacggcuggagcaaucaaaccuugugaauuacgauaagagugagagcuuuucccuguugaacaaucagucugacgauaagcuccaccagcaguucccaaccauuuaucaucugcgcgacuaccugaugaaaucgacagaaaaggcggauauccgacucauuuauuuagcuguccaccauaucgugaaauacagagguaacuuucuggacgccucaccgguugauagcuucgaggcaaguaaucuuaagguggacgaaauauugacucaaaucaaccugcuacucgauaaucugaccgacgaucuuaggcugaacacacaguacgucaccgacauugagcagacuuugcucuccaacacagagucuaauaaagacaaggaaaaggugauccagaaacuguuacugcacaaggaggccauuaaaaucgauaaggaccggaccgcucaaauagcaaaacucguacuuggguauaaggccgauauugcuaaacuguuuggaaucacggaaaaguugcagacucccaagcuagagcugagcgccgcgaacuccgacgaugcacucauggaacugucagccgagcuuaaugaggaccagauuggcauccuguugcagcucaaaacccuguacagucguguucgcuuaaaccaaaucauuccuagcggcacaucucuguccaagucaaugauagaaaaauaugagcuacaccauacucagcucaagagcuucaaagaaaauauccugcuuaaguugagaaggaacaccgcugugcggcgaaaucuggagcucgccuacgcacuguaugucgggaacgcucagacaaagcaagaaguguuugagcccaaaaaggcccgcuucaccagugaugacuuugcgucucuuaaagccaaugcaaaguccgcuagcucggugaaagaggccccaaagaacacgaagacuaaacugacaaccgaugacuucuacaauauuuugacugaacucuucgcuacauuugagucugaacuguccgccgaugaggacaugaucaaggaagucgagcagauuaaaaaggcaauaaccggagacaacuauuuaccuaaacagagaacggaucagaaugguaacaucccacaccaacugcaucagaucgagcuaaggcagauucuccagaaucaacugccccacuacccugaaauggacaagaucaacgagcagaagccaauugaaaaacuuguuaccuuccgggugccguacuauauaggccccuugaucacaccugaggaucagcagaagucaagugccgcuaacuuugcguggaugaaacgcaaggagcaaggggcaauuacuccauggaauuucgacgauaaaguagacagaaugcagagcgccaccaacuuuaucaagaggaugacagugaaagauacuuaccugaucaaugaagacguccuccccgaucguucccuguuauaucagcgguucaaggugcugaacgagcuuaauuugguuaaggugaacaaucagcuccugucuauuggagaaaaacaagcuauauaccacgaccuauuugagaagcagaaaaccgucagcacaaagaaacugcagucauaucuccaaagugaacagggcuacggugauaacaucgagauuuccgggcugagcaauccugacaaguucaacaauggacuuaccacuuauaucgauuuuaagaacauuuucggcgacuugguggaggacacgacaaaacagaaggaauuugagcagaucauagaauggucuaccguauucgaggaucgagccaucuuuaaagcaaagcugcaagaaguuaauugguuaacugaggagcagauuaaagcccucguggcuaagagauacucaggcugggggaggcugaguuaccgccuucuggccgaauuggucaacgacaauggagagcggaucauugauauccucuggaacaacaaggguagcaaucugauguccauagugucucaggacgaguuccagcaacagauugcaagaaucaacucgcaugagguccaggaacuaggcauggagagcgugcuggcgaaugcuuauaccuccccacagaacaaaaaggccauuaggcaaguuaugaaagugguagaugacauccagcucgcaaugaaugggcaggcccccacaucaauaaguaucgaguucacccgcaagccggaagagaacucugaaauuagcaaaucccgauacgagacuaucacaucaauuuaucaaagccugucuaaggauaucgagaaggaagucaaagacaaucuuaacaagaauaaauccaguuugaagaaaaaccugagcgauaaguacuauuuauacuuuacgcagcucggacgggacauauauaccaaucagccuauucccuucaacgagaucccauacuacgauaucgaccacauugugccucguucuguugaaaugaaugauucccugaacaauagagugcuugucgcuaaaucaaucaaccagauuaagaagaacaaugcccccauagacaguagccugaaaaucacuucggagacaaggcaacuauggaagaaacuccuggacuccggcuugauuaccaagcagaaauauuacaagcugucuagcucaaucaagaacacagugaguccauauguaaaacaggguuuuauuaaucgccaguuaguggaaacuucccaaguuaucaagcucgucgcaaacauacuggggaccaaauaccagaaugaugacacggagaucauugaggugaaggcucaucuuaacucugaaauccggaaaaccuucgaguuuuauaagcugagagaauugaaugauuaccaccauggcuucgacgccuaucucacaacucuggugggaggcuaccuauacaacagguaucccaagcugcgaagcuacuuugucuauggggaucacaaacgccuugacaaggcgcagcucuccgagcugaaaaauuucaacuuuuugcacggacugaccaauccuaagucagguagcgauggcuuaauuacagccagugggucucagcaaguugugcucgaccggaacgaaacuaucaaaagacugaauaagauauacagguauaaguacaugcuuauuucccgugagguguucaccaaacagggacaguuuuauaacgagacgaucuacccagcuaagccgaauacagcaaaaaugaucccccugaaggauaacaaaccuagcgaaguauacggcgguuauucgucaucuaaugucaguaagauugccuugauaaaggagaaaaacaccgacaacuaccaguucaucgggauuccaauccgcuccauugcuaagcucaaacaagccaaggcaaauagcaaaacuguguaucagacagaacugaaccggguuaucaagucugugcuagcgagccagaaaaccaagaagcaaaaagaguuugaagucauacuggauaaugugaaguacaaccagguugugguagaccagggcgagaaauauuaccuuggaucccccuauuacaagaaaaaugccaagcagcucgucaucucaccugagagugugaagauucuggcugacaaagccacugcagauuugccagaacaagaggcucauaacaaguuaaugaccguguaccaggaaaucgucgacguucugaauaaacacuucgcccucuaugauauuaacaaugugagaaagaaacugaacgacggccuuaucaaguucagccagcugcccaauuacgaugagacaucuaagaacagguuugacauauccaaaucaauuaagacgaaauaugcaguaaucaugcgaaucuugagugggauuaagaaucagaccagcgaggugccggaacuaggacugaaauccccucucaacaagaugcaaacuaaggguggcaucaaaauaucuccagaggccaagauuuacuauucgagccccacagggaucuucucacauuuuaaacaggucaagaaucuguga

SEQ ID NO: 3298 - RNA, 4209 nt, Artificial Sequence
  Cas9 variant
auggagagaauccugggccucgaccuuggggugagcuccauuggaugggcccuggucgaagaggauguuaagaaccccgaaaauaacaaaauaaucaaguugggugugaggguaaauccuuuaaccauugacgagaaaacaaacuucgaaaagggcaaaucuaucacuacgaaugcugggcggaccucagcacgcagugcccgacguaaccugcagagauuuaagcuaaggcggaagaaacuccuggagauucuuauccacuacaagauaaucaaaaaugaugcggugcuggcugagacaggaaagaacacuaccuuccaaacacaguauuugcgcgccaaagcagccagagaaaagauugagcucgacgaacuggcuaggguccugcucuuaaucaauaagaaacggggcuacaagagcucccgcaaagugcagaacgaugacgaugguaaggcaauugacgggcugucuguugccaaagagcuuuaugagaagaauuacaccccaggacaguaugcuuacgauuugcugaaacgaggcaagaagcaaaucccggacuuuuauagaucggaucuacagaacgaacucgacaggauaugggaguuccagaaacaguaccaucccgauauucugacugacgaauuuaagaaagagcuugaaggcaaggggcaacgggccacagcggcaaucuuccugaaucguuacaaaauuuauaccgccgacaacaagggaacgcgcgaggagaagaaaauccaggcuuaccaguggagaguggaagccuugucacagccucucgaugucaaggagguggcauauguaaucgcugaaauuaauaacaaccugaauaacagcagugguuacuuaggcgccauauccgacaggucuaaaaagcuguauuuuaaugggcaaacuaucggagaguaccucuucgaggagcuuagcgcgaacccacacacccggcugaaaaaucagguguuuuaucgacaggauuaccaagacgaguucgaaaagauuuggaagauccagacaaaauuucaucccgaguugacuaaggaacuaaaagaacagguucgcgauauagucauuuucuaccagagaaagcugaaaucccaaaagggccucaucucauuuugcgaguucgaaaguagggagaucgaaauugaggaaaacgguaagcggaaacgcaagaaaguggggcugaagguggccccuaaaagcucuccacuuuuccaggaguuuaagaucuggcagguccugaauaacauugagauaaagaaugaagacgagagaagguauuuggaacccgaggaaaaggagcuccuguucaacgaguuaaauuguaagggaaaccugaccucccagaaaugccuagaacuccugggcuuuaagucaaaagaugcaaaacuuaauuucaaaguuguggagggcaaccguacaaaugaaaaguuguacgacgcuuuucugaagauccucgagcugcaaggguauaacguauucgaacuucugaaaauuaaggaggauaaagacgaggccaaguugagcgaacucaaagcuagugccgaugagaucaagggaaugaucaaggaaauuuuuaacgcaaaucugauaaacaccucuaucuuagacuucaaugccgagcuggaagguaaagacuuugagaaccaggcuuccuaccaguucuggcaccuaauguauagcuacgagggcgauaauucgccuucugggaacgaaaagcucuaugagcugcuugaaaagaaguuuggauucaaaaaggagcauuccaagauuuugucaacgaucguguuuagucaggaguacggcagccuguccacuaaagcgaugcggcgaauuuacccauauaucaaggacaauaaauacucugaagcaugucuccuggccgguuauaaccacagcaagcacucauuaacaaaagaggaacuggagaauagaaaacuuaaagaacaauuggagguccucccgaagaacagucugaggaaucccgugguugagaagauacuaaaccagaugaucaaucuggugaacgcuaccauuuccgaauacgggaaacucgauggcguccgcaucgagcuggcccgggaacuuaagaaaagcgcacaggagagagaagacauggccaagucuauuaaugaggcuacuuugcugcaucagaaauaugccacaaucuuaaagcaagaguucggagugguaaacccuucaaggaacgauauaauucgcuacaagcucuauauggaacugaccguuaauggcuacaaagaccuuuacacgaacaccaagaucgagaaagaaaaucuguucacagauaaguaugacauugaucacaucauaccacagagucgauuuuucgacgauagcuuuuccaacaaaguguuggucccccggcagucuaaucucgacaaggggaaccugacugcauacgauuucaugucgaauaagggaagcgagcgugaggaacauuuucuaaacgugaucaaagagcugcucgacaaggguuccauuucaaaagcgaaguaugaaaaacugaagaagaaaggccuugagaucggggacggauucauugaaagagauuugagggacacccaauacaucgcuaagaaagccaaggagauacuguuugagauuacaaauagugucgugacuaccucuggccgcaucacagauaaauuacggaaggacugggaucucguuaacaucaugaaggaacugaaucuugacaacuauagaaggcugggucuaaccgagauugugcgaaauagcaaaggggaagagaaggaacucaucccugauuggacuaaacgcaacgaccaccggcaccaugcaauggaugcccugacgguagcuuucacaaccagaaaucacauucaguacuugaacuaucugaacgccaggaaggacgagaaacauaaggagcaccagaauauauacgcaaucgaaaacauuaucacugaggucauugagaaaaagaauggcuccaagacccgucgcuuuaaagcuccaaugaacucauuccggcaugaagccaagcagcacuuaaaagaaauccucgugagccacaagaccaaaaauaagguugugacaucuaacauaaauaagacuaaaaagaaaggaggcauccauaagaaaacagagcugacgcccagagggcaacuucacaaggagaccgucuacggauccaagaaauuucugcagaguagggaagagaaggugagcgcgaaauucgauuaugaaacuauuuugaugguagugaacccgauccaucgaaaugcccuccugaaccggcuaaaggaguacgguaaugacccuaaaaaggcuuuuucuggcaagaacgcaauuaauaaaaaccccguuuaucuggaugacuccaagacagacauccuuucagaaaaagucacccucaguugguacgagacaggguauacuauacgcaagagcgugaccccagauaauuucaaagacuacaagaaccuggagaaaauuacggauuugggaaucaagaagauccugaaagaaagauuagaccaguucaagggcaaugccaaagaggcuuuuucgaaccucgauaaggacccuauuuggcugaacgaagagaaagguauagccaucaagaccgugacaauuacuggggucuccaaugcagagucucuucacuucaagaaagaucaccugggcaaggaaaucuuggacgagaacggaaauaaaauucccggcgauuuuguuagcaccgggaacaaucaucaccucgcgaucuaucuggacgaagaggaaaagcuagaugacaaaauggugacauucuacgaggccgugcugaggguaaaccagggacuuccagucauagacaaggauuacaauaaggagaaaggcuauaaguuucucaugacucugaaacaaaacgaaauguucguguuucccaaugaggacuucgauccuaacgaaaucgacuuguuagaugagcggaaucuggaacgaauuucaaagcaucucuuuagaguucagaaaaucaguaagguggguuacgggaacuccuucguccgcgacuuuguguucaggcaccaucuggagaccacgguugaggaacguaaggagcuucggaauauuacauauauccagcugaaaucuuuggaaggacuaagaaacauaauuaaggugaggcugaaucaccucggcaaaaucguacagaucggugaguacuga

SEQ ID NO: 3299 - RNA, 4215 nt, Artificial Sequence
  Cas9 variant
augaccaagaacauccugggccucgaccuuggggugagcuccauuggaugggcccugguccaggaggauucuaaaaaucccgaaaacaauagaauaguuaaguugggugugaggguaaacccuuuaacaguggacgagcaaaucaauuucgaaaaaggcaagccaauuacuacgaacgcuucacggacccuggcacgcagugcccgacguaaucuacagagauuuaaauucaggcgggcgaaccucaucgauguccugaagaagugcaauauucuuaaacagggggaccuguugacagagaucggaaagaacagcacuuuucagacccaagaacuccgcgcuaaauccgccaaggagaaaguggagcugucugauuucguuagagugcugcucuuaaugaauaagaagaggggcuaccggucgucacgcaaagcaaagaacgaagacgagggucagauaaucgaugggaugagcgucgccaaaaagcuguaugaagagaaucuuacaccgggagaguacaguuaucaguugcugauugaaaacaaaaagcagcuacccgacuuuuaccgauccgaucuccaaucugaguucgacagaguguggaaauuucagaagcaguucaauccugaaauccugaccgaugaccuuuauaaggagcugcagggcaaaaacaagaacgcuacuugggcaguauugaaagaaccauuuagccucguuggcauuaagcaaaucgggacaauacaggagaaaaaggccgagaaguacuucuggagguccgaagcugugaaacggcagcuggauuuugagucauuagccgucguguuccaagaaauuaauaguaaccugaauaacagcucuggauaucucggugcgaucuccgaccguucaaaggagcuuuacuuuaauaaccagaccgugggcgaauaccuguuccagcaguugaaagagaauagccacacgaagcugaaaaaccaagucuucuaucgccaggacuaccuagaugaguuugaaaagauuugggagacucagaguaaguauuacaaagaacucaccaaggagcugaaagaagagaucagagacaucauuauauucuaucagaggaaacuuaaaucucaaaaggggcugaucuccauuugugaguuugaaaaucgggagaucgaaauaacagagaacggaaagauuaaaaagaaaacuguuggcuugaagguggcacccaaaagcucgccucucuuccaggaguuuaagaucuggcagguacugaauaacuuaguguuccagucuaucgaauccaaagagcuguuuccacuagaucucgacauuaaggaaucaaucuucaaugaggucaacauuaaggguaaucugagugccaaaaacgugcuugauuugaugggguacagcggaaaggaauggaaaaccaacuuuaagaauauagagggcaaccgaacaaaugagaaccuguauaccgcuuuccucaaaaucauugccuccgaaggcaucgaguuucccaaggaguucaagcugucuaucgacgaugacauuaaaguuagcaagauagauaucucaagugagaaaauuaaggaauuuaucaaagaaaauuuccuuaagcuggggauuaacacguccaucuuggacuucaauccugagcucgauggaaaggacuuugaaaaacaagagagcuaccagcuguggcauuuacuguacucuuaugaaggugacgauucagcaaguggcaacgugaagcuauacgagcuccuggagaaaaaguucggguuuaaaaaggaacacagcaagauacuugcugacgucggauucuccccagauuauggcucuuugucgagcaaagccaugcgcaagaucuacccguauauuaaagagaauaaguacuccgacgcgugccaucuggccgguuauaaccacaguaaaaauucauuuacuaaggaucagcucgcaaacagaauccugaaagaacaguuagagauucugcccaagaaugcucuuaggaacccugugguagaaaagaucuugaaucaaaugauaaaccucguuaacgaggugauuaaagccuacgggaagccagacgagauccggauugaacuggcucgcgagcugaaaaagaaugccgaagagagagcaaacaugacaucugauaucagcaaagccacccuacuccaucagaaguacgcugaaguccugcagaaggaguucggcauaaaagcgcccuccaggaaugacaucauucguuauaaacuuuacuuggagcuggagaagaacuuauuuaaggaucucuauacugacgugcaaaucaaacgggaagaacuguucacagauaaguacgacauugaucacaucauaccucagucacgauuuuucgacgacagcuuuucuaauaagguccuugugccaagaggagcaaaccugaaaaagggcaauuucaccgccuuggauuauauggagauugaagggaaagagaagcucgagaaauuucugaacaucaucaaggaacuauucgacaagggagcuauuuccaaagccaaguucgagaaacugcagaagaaagguagugaaaucggcgagggguuuauugaaagggaucuccgcgacacgcaguacauagcaaagaaggccaaagagauccuguucggaauuaccaauagcguuaucucuacauccggccggauuacugauaaacuuagagaggacuggaacuuggugaauaccaugaaggaacugaacuuagagaaguauaggaaacucggucugacagaacuuaucguaaauucaaagggggaggagaaagaacgcauaaucgauuggacuaagcgaaacgaccaccggcaucacgcuauggaugcccugaccgucgcauuuacaacccauaaucacauucaauaccuaaacuaccucaacgcgcguaaggacgagaaacacaaggaacaucagaauaucuucgcuauugagaacacuaucacggaaauaguggagaaaaagaauggcaguaaagagagaagguuuaagcugcccauuaagaacuuccgcacagaagccaaaaagcaguuggaggaaguucugaucagccacaaagcaaagaauaaaguggucaccaagaacaucaauaagauuaaaaagaaaggaucgauaaucgccaagacugaguuaaccccgcggggccagcuccauaaagaaacaauuuauggguccucuaaguuucugaagaccaaagaggagaagaucagcggaaaauucgaucuugaaaugauucaaaaggugcagaacgagaaauacagaaaugcucuguugaagaggcuccaggaauuugguggcgacucaaagaaggccuucacugggaagaacguaaucaguaaaaauccuauauuucugaacgcagagaagacagaacagcuacccgagacggugacccuggcuugguaugagacuggauacacaauccgaaaaguugucaauccagauaacuucaaggacuucaaaaauauugaaaaggugaucgacaagggcgugcgcgauauucuuaccgagcggcucaaagaauuuaacgguaauuccaaggaggccuucucuaaccuggagaaaaacccuaucugguugaauaagagcaaagggauauccauuaagacagucacuaucaccggcaucaacaaugcggaagcccugcacuauaagaaagaccauuuaggaaaggagauucucgaugaaaacggccaaagaaucgcuguugacuuugugucaacggggaauaaccaccacguggcaauauacgaggaugacaauggaaaccugcaggaaaaaguagucagcuucuaugaggccguggagaggguuaaucagaaccuucccauuaucaauaaggaauacaacuuugagcugggcuggaaauucuuguuuaccaugaagcaaaaugaaauguuccucuuuccaagugaugacuucgaucccaaggagguggaccuguuugaugacaaauaccuaucucugauuuccaagaaccuuuuccguguccagagcaucucgauagugcaguaugguaauucaguuauucgcgacuuuaaauuccggcaucaccucgaaacaucugugagugaugagaagaaacugcaggggguaacuuaccaacagaucaaguccuugcagccuuuaaaagacaucauuaagaucagacugaacaaccucggaaagauuguccagauaggcgaguauuga

SEQ ID NO: 3300 - RNA, 4215 nt, Artificial Sequence
  Cas9 variant
augaagggcaacaucgagaaaaagaaacaggaguucaaugacuacuaucugggguuugauauuggaaccaacagcguggguugggccgucuccgaccucucuuacaaucuucugagauucaacaagaaagauauguggggcgcuagguuguuugacgaagcaaagacagccaaggaucggcgcguuaaacgaaauucacguagaagguuagaacggcgcaguaagagacugaaauaucuagaggaaauauucgagacugagaucugcaagauugacaaaaacuuuuucaggcggcucgaagagagcacgcugcacaaugaagauaagaccuuugacuuccgcuuucccaucuucaacgaugagaauuacacagacaaggaguauuacaaagauuuuccuacuguguaucaucuucgaaacgaacugauuaagaaugagaacaaaaaguucgacaucagauugauauaccucgcgauccacaauauucugaaauacagggggcauuuuaucuucgaaggacaagauuucgacuccguaaccgacuuuaaggagguguucucugaacugucggcuuaucucucagagaacuuagaggaaaaucuggauauuaaccuuugugacaacaucaaagauauaauuugcagcaaggagaauaagacaaguaaaggcaaguccuuugucucuuugaucgacagcaaagugauucaguccguucugcgguguugcaucgguuaccgugugaaguucaaagauaucuuuauuaacuaugaagagaaggaaaagaaugaggggauaaaccuaucagagaucgaauacgacgagaaacgcgaugaaauugcccucagucugggagagaauauccuucugauagacauuuguaagaaagucuaugauuucaugaucuugaacaauauccucaagggcaacaaauacauuagcgaaucuaaggugaaucuguaugacgagcacaagugcgauuuauguaaccugaaauacaucuuuaagaaauaccucccaaagaaagacuauuucgaguuuuucagaaaugaaaacaaggagaagaauuacguauccuauauuucaagcagucuuaacaauggcaaaaagaaaaauaccugcacucaggaagaccugaacaaggagauaaaagaguacaucgcaaagauuaaagaauaugaggaaaacgaugccguuuuggagaagaucaaccuaaagcugaaugaaaacaaacuccugccgaaacuuaaaacaaaugacaacggggugauccccuaccagauucauaagauagagcuggagaaaaucuugcaaaaucagucuaaguauuacgauuuucuccuggaaaagauugacggaaucaccaacauugagaggaucgaaaaauuauucacguuucggauaccuuacuauaucgguacucugaagggcaaauucuccugggcuaagcuaaaagagaauaagaagauuaccccauggaacuucgaaaagaucgucgauauggaggagagcgcaaaggccuuuauugaacgaaugucgaaucgcuguucuuaccucaaaacagagaacgugcugcccaaaaauucccuuuuguauucagaauacgagcugcucaacgaacugaauaaagugaagaucaagaacgaguucauaaacgucguucuuaaaaaugagauuaucgacgaacuguuuaagacuaccaguaaagugacaaagaaaaaguucguagauuauuugaaaaccaagcagauuuuuguggagaaggaagacaucagcgggcucgauaacgaguucaaauccaagcuggacucuuacauaaaauuuaagaaagucaucggagauaagauugacacguuaagaggcuauaauuucguggagaagugcaucgaauuuaaauguuucuacggugaugacaagaaacuguuuaagaacgcuauuaauaacacugaguucaaagacuacguuagcgaugacgaacuaaagaagaucaauaaaaugaaguuuaacaaaugggggaggcucucaaagcggcugcuuacagagauaugcuucgaaaaugugauugagagugaguccuucgaaaacaucaucgucgccuugcgcagcaccaauuauaacuuuauggaguucacuucuaaaaaguuuaaucugucagaaaagguggcggaggaaaaccaggagaauacacucgagaaauucaacauuaacgaauacguagaugagcuguauguuaguccuagcgugaagagauccaucauucaaaccuacaaaauagcaauggaaaucaagaaaauuacgggaaagaauccaaagaaaaucuuuauugagauggccaggggcggcggggaaaaggggaaaaagaccgagaaacguaaggagcggaucaaaacauuauaugcuaacaugaaggacucuaaugaagaguuccugaacaaucuugauaacuugaagcucucggucgacaauuacgaugacaaccgacugagagaaaagaagcuauuucuguauuucaugcagcucgguaaaagcauguacacuggcaagaauauagaucugaacgagcuuuuguuugccaauaccuacgacaucgaucacauuaucccccaguccaaacugaaggacgauucauucgacaacauuguguuagucgagaagacaaucaauaaagacaaggauaacagggacuaucucgaugaaaguauacgccugcggaugaauaaauuuuggaacuuccuuagagagaagggguucauuacuaucgaaaaauacaauaggcugcgccgaaacaccuauuuuucugacgaugaguugagcggauucaucucccggcagcucgugacaacccgucaaucaacucuggaaguuaagaagcuauuugaguucauuuuucagaacacggacgugguaugcagcaaagcaaaucuggucucugauuucagagagaaguacggcauaaucaaagugagggaccucaacgaugcucaccaugcccaggacgcguaucugaauauuguuguggguaacgucuuugauacaaaguucaccaaaaauuacuggaaguuuaucgaagaccgccggaagguggacaacauuagagagacuuauaauuucaaaaagaucuuugauuacgacguauccaggggagaaaacguggccuggcuuaaagauuacaguauaaauaccaucagcgagaugauuaacaagaaaacagcaaauaucacccaaaugauuacugaaggcaagggacaguuguucgaccugacaauccucaaaaagucuaagauagauaaaaaguuaacgguuauuccuaacaccccaaaaauccugaaguccucacuuaaagacaguuguaagaucgcugagaaguauggcuacuuuagcacucugaugccggccuauuucgucguguucaaauacauugauaagaauaaagagguguuuggguucgaccgaaucuuuauauucgaucgcgaaaagauuaacucgaaugaggacaucgaaaaauaucuagaggauaagggauacaacucccccaaguuuauucggaaagucaaccucaagcagaaaauccuguugaaugguuauccuuacagaauaguuggcuucacagacaacaagcuggaaauuaaaaauucuaagcaguuuuacagcgauggggagcacuuaaaguauaucaaacaucucucagcuuucuacaacaauaacaauaacgugaagaauggagaguauaggaucaacuuucugaaaaagaccagugaaaaugaccguaacgagacaacugacgaagccaaagagcgccuuaauauugaguucaucaagcuguacgaauauuuuugcgagcgguugaacuccaaaauuuacgcaaauuauuacaacucuaagaaguacgaugaacucauagagguguucgacuguuuuaaaaaccugaaucuacuggauaaggccaaacuucuccuggaguucuugaagaucuucaaaaaggacaccuauggcaacuuuaagcuguuagaaaaaccagagcucgauaagaaugguaaacaaaagcuggacaaaaacgggaaucuuagcuucgaaggccuguccauggcuuuuggaaaguugaacggcaagaaauucaagcagcucguagagaaagauauucaguuugucgacgaaucagugacggggcuguucgagaagaaagaaggacuagagaaguggcaggauggugagcaauga

SEQ ID NO: 3301 - RNA, 4215 nt, Artificial Sequence
  Cas9 variant
auggccaagaaaauccugggccucgaccuuggggugagcuccauuggaugggcuauagucgaggaagaugcagagaacguuaugaauaacaagaucgugaaacuggguguaagagugaaucccuugaccgucgacgaacagauuaacuucgagaagggcaaaccuaucacaacuaaugccgggaggacguuagugcggggagcgcgccgaaaccugcaacguuuuaagcuaagaaggcuccaccugauugauauccuucagaagcggaauauacugaaacaggcugacuugcucgccgaaucuggccgcaacucaaccuuccagacacaagagaucagagcaaagagugccaaacagaagguugagcugagcgaacuggcuagggugcucuuacugauuaauaaaaagcgggguuacaaguccucucgcaaagcaaagaacgaggaugaagggcagaucgucgacggaaugucgguggccaaaaaguuguaugaggagaauacuaccccaggcgaauacucauaugaguugcugaaaagcggcaagaaacagcuaagugauuuuuaccgauccgaccuccaagcugaauuugauagaguauggaacuuucagaagcaguucuauccggagauuuucucugacaaucuguacaaggaacuucaggggaaaaacaagaaugccacauggaaaauccuggagauacccuucagcuugguuggaauuaagcaaguggguaccacucaggagaaaaagaucgaaaaguauuuuuggagguccgaggcggucaaaaagcagcucgauuucgaaucacuggcagugguguuucaagagauuaacaguaacuuaaauaacagcucuggcuaccugggggccaucuccgaccggucaaaagaacucuacuucaauaaccagacagucggagaguaucuucauugccagcugaaggagaauccucacaccaaauugaagaaccagguguuuuaccgucaagauuaucuagacgaguucgaaaagaucugggaaauucagagcaaauaccauacggugcugacuaaggagcucaaagaagagauacgcgacguaaucauuuucuaucagagaaagcugaaaagucagaagggccuuaucucuauaugugaguuugaaaauagggagauugaaaucaccgagaacgguaagaucaaaaagaaagagguggggcugaaggucgcuccaaaauccagccuucucuuccaagaauuuaagauuuggcaagugcugaauaacuuacaguuccagaauaucgagucgaaagaaauuuuuccccuggaucuagacugcaaggagucuauauucaacgaaguuaauaucaagggacggauuuccgccaaagcagugcucgauguccugggcuacucaggcaaggaguggaaaacaaacuuuaaggacaucgaggggaauaacaguaacgaaaaucuuuauaacgcuuacuugaaaaucauugccaaugagggaauagaguucccuaaggaauuuaaguguaaccuggaugacgauaucaaugugagcaaaauuaucugcuccgcggguaagauuaucgaguucguacgagaaaaauuuucugagcucggcauaaacacuagcauccuggacuucaauucagaacuugaggggaccaacuuugaaaagcagaaaaguuaccagcuguggcacuugcucuauuccuacgauggagacgauagcccaucuggcaaucagaagcuguaugaguuacuggaaaagaaauucgguuucaagaaagagcauucaauuauccuagccgacauuggguuuccccaggaguacggcagucucagcacaaaggcaaugcgcaaaaucauaccucaccugaagaccggacuuccauucgcuaagaaauccgacaacgauacgauuuugucugccacugcuauggccggcuauaaucacagcaagucgcugacaaccgaggaacucacuaaaagaguucugaaggaacauuuagagauccugccgaaaaacucccuuaggaaucccguggucgagaagauuuugaaccaaaugaucaauguggucaacgaagugauaaaagaguacgggaagccugacgaaauccggauugagcucgcacgcgaacugaagaaaaacgccgaggagagagcuaauaugacaucagaaaucggaaaggcgaccauucagcaccagaaauauagugagauccuacaaaaggaauuugguauaaaaucuccaagcaggaacgauauuauccguuacaagcuguaccucgagcuguccaauaacggcuucaaggaccuuuauacggauauccagauuaaacgggaagaguuguuuaccgacaaguacgauaucgaccauauuauaccccagucacgauucuuugaugacagcuucucuaauaaaguucuggugccuagaggggcaaacuuaaagaaaggaaaucucacagccuuugauuaucuggaguccgaaggcaaggacacucuugagaaguucaucaacaccauuacagaauuuuacgauaaagguaucauuacuaaggcuaaauaugagaagcugcagaaaaaggggaccgaaaucggcgacggauucauagagagggacuugcgcgauacacaauacaucgccaagaaagcaaaggagauucucuuuggcaucaccaauaguguagucagcacuucugggcggauuacggacaaacugagagaagauuggaaccuagugaauacaaugaaggagaugaaccuggaaaaauauaggaagcgcggacucaccgagacuguuaucaauuccaagggugaggaaaaagagaagauaauugacuggucaaaacgaaacgaucaccggcaccaugccauggacgcucugaccguggccuucacaacccacaaucauauccaguaccuuaacuacuugaacgcacguaagaaugaagaucacaaacagcauaaggucaucaguaacauugagaaucugauaacuaaaguguucgaaaagaagaacggcagcaaacagagaagguuuuuagagccaauccacaauuuccgcauugacgcgaagaaacaccucgaggaaauccugauuucgcauaaggcuaaaaacaagguagugacaaagaauaucaacaaaauaaagaaaaagggguccaucauugccaaaaucgagcuuacgccccggggacaacugcacaaggaaaccauuuauggcucuagcaaguaccuaaaaacuaaggaugagaaacucucagguaaguuugaccuggaaacaaucaauaaaguucagaacgagagauauaagaaugcauugcuggagagguuaaaggucuucggguacgauaguaaaaaggccuuuaccggcaaaaacauacucgcuaagaauccgauuuuccugaacaucgagaaaacagaacagcuuccugaagugcugacuuuggccugguaugagaccaucuacacgauucgaaaguccaucaauucugacaacuuuaaagauuauaagaauauagacaaggugaccgacaaaaagguccauaacauucucacagaucgccugcgggaguucaacggaaauagcaaagaagcauuuuccgaccuagagaagaaccccaucuggcugaauaaaccaaagggcauugcuaucaagacuguuaccauaacaggggugaacaauguggaagcccuucacuacaaaaaggaucacuucggaaaagaguuucucgacgaaaagggccauaaaauuccuguagauuucgucucaacugguaacaaucaccauguggcgaucuacgaggacaccgccgggaaccugcaggagagaguuuugagcuucuaugaagcuguggagagggucaaucaaggacugagugugaucgauaaggaauacaacucuuccuuaggcuggaaguuucucuucacgaugaaacagaaugagauguuucuguuccacagcgaagacuuuaacccccaggagauugaucuuuaugacgagaagaaucugcguuugaucucgaaaaaccucuuccgcguucaaaaguuuacagugaaagauuacuucuuucggcaucaccuggaaaccaauguagaggacaacucaaagcuaaagggugacacuuggaaaagagaaggccugaacgggauuaggggaauacuuaagguccgacucaaucaccugggcaaaaucguucaggugggggaguauuga

SEQ ID NO: 3302 - RNA, 4215 nt, Artificial Sequence
  Cas9 variant
augagcaagaaaauccugggccucgaccuugggaccacauccauuggaugggccuucgugagagaggcugaagauuuucaggaggaaucuucaauagagaggaucgguguccggguuaacccccugacuacggacgaacaaauuaauuucgagaagggcaaaccuaucagugugaacgcagaucgcaccuugaagcgaggggcccguagaaauuuacagagguacaaacagcggcgcacaaaccugauucagcuacucaagcaauauaagaucauaaaugagaacacuauccuggcggaagacgauaaaaauaccacacacagcaccuacgcucuuagagccaaggcaguauccgagaaaauuucuaaggaagccuuugcuagggugcuguugaugaucaacaaaaagcggggauauaagucgucacgcaaagcaaagaaugaggacgagggccaggccauugaugguaugagcgucgcuaaacgacucuacgaagaggacaucacuccagggcagcugugccugcagcucuuaaaggaaggcaaaaagaaacugccggauuucuaucuuagugacuugcaagccgagcuggaaaagauauggaacuuucagaagaaauucuaccccgagauucuaacagaugaguuuaagaaagaaaucgagggaaagggccagagagcgaccuccgcaucuuucugggccaaauauaaguuuaauacggcugaaaacaaggggagcagggacgagaaaaagaugcaggccugggaauggcgguccaaagcaauuaauacucaacucacccgugaggagguggcuuacguuaucacagaaaucaacaauaacauuaacaauucaaguggauaccugggugccauaagcgaucgcucuaaggagcuuuauuucaacaaagaaacugugggcgaguaccuguuuagacaguugagguauuccccucauacccgggucaagaaucagguguucuaccgacaagacuaucucgacgaauuugagacaaucugggagaaccagucacgcuaccacaaugaacugaccaacgaguuaaagagcgaaauuagagauguaguuaucuucuaucagaggaaacugaagagucagaaagggcucauaucuuucugugaguuugaguccaagcaaauugaaauccagaaagacggaaagaucgugaagaaaauuaucggccuuaaggucagcccaaaaucgucuccccuguuccaggaguuuaagauuuggcagauauugcaaaaucuagaguucacgaacaaagaaacuaaggagaaaaaggugccugauuuugaagcgaagaaucuacucuucgaggaacugaacaucaaagguaaucuuaagggggagaaagccauugaaauccugggauacaagccaaaagagugguuggugaacuacaaggaacucgacggcaaucggacaaaccagguccuguaugagggcuacuuaaagauccuggagguugaaggguaugauauuaaagaccuacucaagauaaaauccaauaaggaugaggugaaccugucagaacuuaguaaacccguaagcgagaucaaggacuugauuaaguccaucuuugaaucucugaacauuaauaccgcaauccucgauuucaacccugagcuggagggaaaagacuuugaacgccaggcuagcuaccagcuuuggcaucuguuguauucauacgagggugauaauaguaacacuggcaaugacgaacucuauagacuguuauaccaaaaguucggguuuggaaaagagcacgcccagauacuggcuaaccuauccuucagccaggacuacggcucucucucagccaaggcaaugaggaaaaucuauccauuuauuaaggagaauaguuacagcgaagccugcucccuggcugguuauaaccauucuucgagcaucacaaaggaggaaaaugauaaacgugagcuuaaggaaaaauuggagcugcucccgaagaacucccugcggaaucccguggucgagaaaauuuuaaaccagauggugaauguuaucaacgcgauaauugcagacccuucaauggggcgaccagaugaaaucagaauugagcuggccagggaacuuaagaaaaaugcugccgagcgcgcagaaaugaccauccacauaaacaaggccaagagugagcacgacaacuaccggaaaaucuugacgaccgaguucggcauucccaauccuacaagaaacgauaucauuagguauaagcucuacgaggaacugaaagugaauggauauaagacucuauacucuaacaccuacaucccacgcgaaaaacuguucagcaaggaguuugacgucgaacauauaauucccaaggcucuccuguucgaugacuccuuuucaaauaaaacaaucugugcccgacaagagaaccuugauaagggcaauaaaacugcauucgacuuuauccagagcuucuaugggaaggagaaauuugaagaguacuugcagcggauugaaucucuggcgaagaucaaggagggagauaccuucgugauuuccaaagcuaaguauaaaaaguuacuccugccggagauagaaaucggugagggcuuuauugaacgugaccuuagaaacagucaauacaucgccaaaaaggcaaagagcaugcuguuggauauuugcaaaacaguaguuccuaccacugggucuaucacggacaggcuccgcgaggacuggggacugauaaauaucaugcaggaacuaaacuucgagaaguauaaaaagcugggccucauugagaugguggagaaaaaggaugguuccuuuaaggaacggaucacagacuggaccaaaagaaaugaucacaggcaucacgccauggacgcucugacugucgccuucaccaagcacaaccauauucaguaccuuaauuauuugaacgcacgcaaaaaugaaaaccacaagaugcaugggaacgugaucgcuauagagcagaaagaaacagagcuguuagucgauucagugggcaagcgaaaacggaaguuuaagcuccccauuaguaauuucagagagguugccaaaaugcaccuggaaaacauccuugugagcuacaaggcgaaaaauaagguagccaccaaaaacaagaauagguucaagacuaaaaacggagagaaggucaaaaucgaacugacaccacguggccaacuacauaaggagacgguguacgggaaaaugaagaaguaugaaaccaaagaggagauuauaggaucgaaguuugacgaagcuacuauccucaaaguugcaaaucuggagcagcgcaacgccuugcugcagcgguuaaaggaaaauaacaaugauccuaaaaaggcuuucuccgguaagaacucucucaaaagcaauccccuguacuauggcguggacucaaagccaauucccgagagaaucaaaauugucuggcuugaggaugacuacacaaucaggaaggaaauaaccccugaucugaaaaucgacaaggugauugauaucgggauucgacggaucuuggagaaccgccucgccgaauuuaauggaaacgcaaaagaggcguucaguaaucuggaaaagaacccaauauggcuaaacgagggcaagagaauugccaucaaaaggguaacaaucuccggugugaagaaugcugagacucugcacuauaaaaaggaccaccuugggcaugaaaugcucgacaaacagggcaagcggauuccgguugauuuugucucuaccggaaacaaucaccauguggccaucuacaaggacgauaaaagcgaccugcaagagaagguggucuccuucuaugaagcaguugagcgaauaaaccaggaauugcccauuaucgauaaaucauuuaaucacgaccugggcuggcaguucuuauuuacgaugaagcagaacgaguacuucguguuuccuagagauggguucgacccauacgagauugaucuccugaaucccgacaacuauaaaaucauaagcccuaaucuuuuccgcgugcaaaagauugcuaccaagaacuacguauuuaaucaccaucuggaaacaaaagccgucgauggagaguugcucaagacuaaaaaggaccugagugacaucaccuauagguucauccagacaccagugaaccugaaaaauauuaucaagguucguauuaaccacauaggccagaucgugaagauuggugaauacuga

SEQ ID NO: 3303 - RNA, 4218 nt, Artificial Sequence
  Cas9 variant
augaagaccauccugggccucgaccuugggacaaacagcauuggaugggcccuggugaaagaggcugaaaauuccaacgagaagucugaaauaaucaaauugggugucagaguuaaucccuuaacuguggaugagaagacgaacuucgaagcaggcaggccucugucaaccaaugccgaccggacagcgaaacgcagugcucgacguaaccuacagagauacaagcucaggcggaagaaucugauugaucuucugaucaaaaaccaauugauugacaaggauacuccacucaccgagaucgggaaaaauacaacccaccagacucuggagcugcgcgccaaggcagccagagaaaggauagagcucgaagacuuagcucggguauuucuggcaaucaacaaaaagcgcggauaucgaagcuccagaaaggugaauaacgaggaggaaggccaggccgucgaugguauggcuguggccaaaaaguuguacgacgagaauuugacaccggggcaguaugcguacgaacugcuaucuaaaggaaagaaauauguucccgauuucuacaggucggaccuccaagcagaguuuaacgccauuugggaauaucagaagcaguucuacgcugauauccuggacgaugagcuuuacaaugcccugaaaggccagggccaacagaacucacggaagcguuuucuugcaauuaaggggguguauaccgcugagaacaaaggaaagcgcgacgacgucaaacucagacauuacaaguggaggagcgaagccaucaguaaaaagauaaauauugaggaaguggcguauguacugguugagaucaacaaugauuuaaacaaguccucugguuaccugggcgccauuagcgaccgguccaaagaacucuauuucaauaaggagacggugggggagaaccuuuggaaacagauccagaagaauccucacacuucacugaaaaaccaagucuuuuaccgacaggauuauuuggacgaguucgagcagaucugggaaacccaagcacaguuucauccacagcuaacacuggcucucaaggagcagauucgcgaugugauaaucuucuaccaaagaaagcugaaaagucagaagggacuucugagcuuuugccaguucgaaucuugggagauugagaggaaagacgaaaauggcaacgugaucuugaauaagacuacccagcuccccaaacggcaaacagucggucgcagaguugccccuaaguccucaccacuguuucaggaguucaagauauggcagaacauuaauaacuuagaagugaccaaaaucagcgagggggcuaguaagaauaaaaaggagacggaaacucugucugaugacgagaggaaacuacucuucgaagaacugaaccuucguggaaacuugucccagaaggaaguacugcaaauccucggccugaaagauaaggaguacaagacaaauuuuagcgagggccuugaagggaaccggaccaaugccgcacuguucaacauuuaucagcagaucgccgagaaugaaggauacgguuuugacuggucgaaaaagucugcucaggagauuaaagaagaguugaaggcgguguucccccaaauaggcauccaggcagauauucucgacuuuaacgccaaucuggacgggaaagaguucgaaaaccaggcuuccuaucaauuauggcaucugcuauacucagccgaggaagaugacaagaucaaugaggaagaucagaucauuuauggaaacagugcagucagccucaagaaaaagcugugugagaaauuuggcuucacuccugaguacgccaaguggauagcuaaugugucccuucaggacgauuaugguaacuugucuacaaaagccaugcgaaagaucauuccauaccugaucgacgggaaugauuacagcgaagcaugcgcgcucgcuggcuauaaccacucaaauagucugaccaaggaggaaaacgacaacagagaguuacuggauaaacuugaguugcucccgaaaaauucccugaggaaccccguuguggaaaagauucuaaaucagauggucaacgugguaaaucaaguuaucgagacguacggaaagccugacgaagugcgcauagagcuggcccgggaacucaaaaagagcgcagagaagagagccgagaugaccaaaucuaucaacgaagcuacaaggcgcaaugaggauauuaagaaacugaucacuaaggacuuuggcauuccaaaccccaccaaaucagaugucgugcgauaucggcuuugggaagaguuggccccucuggcauacaaggacgucuucacagggaaacagaucaagaaggaagacuuauuuaguagcaaaauagauauugagcacaucauuccaaaggcucuccuguucgacgauuccuuuucuaauaaaacucuuguguuccgugagaccaaccugaagaaagccgacagaacagcguaugauuucaucgaaucggacuacaaugccaccuuggaugacuauauacagaggguugagacucucuacaacaauacgaagggaacaaucagcaaggguaaacgcaacaagcugcuaauggcucagaaaaaucugcccgauggcuuuauugaacgggaccucagaaacucccaauacaucgcaaagaaagccaaggcuaugcuguaucagguguucaaggauguaaacgucaccucagggaguauuacugacaggcuucgagaggauugggacuugaucaaugugaugaaagaacugaacuuuccgaaguacaaagccuuaggacucaccgagauagaggaacgcuaugacauuggccaggagaagacaaaacggguugaagugaucaccgauuggacuaagagaaaugaccacaggcaucacgcaaugaacgcgcugacagucgccuucacgaccucuagccauauccaguaccuuaauuaucugaacgcucguaagaaugagucccacaaagagcacaagaacauuaaagguaucgaaaauaagauuacucauaaacaaaaggauaagcgcaaauuuauaccucccaugccaaacuuccgggaggaagccaagaaacacaucgagacaauucuagugucaaucaagaauaaaaacaagguauacaccaaaaauauuaacaagacaaagaaaaagagcgggcauaauacuaaagaacagcucaccccuagaggccagcugcacaaggagacgguguauggaaaaucuaagaggcccauguccaagccaaccaaaaucaacaagaauuuuaguuuggagcaagcacagcugauaaucaacguucaggaaaaagaguuaguccuccgacaucuggcucaguucgacaacaaucccgccguggcauuugauacaaagacucuuaaaaagaugccucuguugaagaacggcgaaccacucaaagaggugcuguguuucgaagagauuuuuaccauccggaaggacauuacaccggaucuaaaaaucgagaaggucguugacgagaaaauaaaggccauucuggaacaacgcaagaaagauuucgggggaaaugcuaaggaagcguuuagcgaccuugauaaaaaccccaucuggcucaauaagaaaaaggguaucugcauuaaaagagugacuauaaccggcgugucuaacgccgaggcacugcaccaccagaaggaccauuuggggagggaaauccuggacgauaauggaaacccuauuccagcugacuucguauccacgggcaauaaccaccauuuagccgucuaccucgauucagaggguaagcugcaggacaauaucgugaguuucuacgaggccguugugcggacaagccaggggcuucccgucguggauaaaggccugaacaaggacuugggauggaaauuucucuucucgcugaagcaaaaugaaauguuuguuuucccuaacgaugacuuugauauuaaugacuucgaucuacuggacgauaaaaaggcugagcuuaucuccaagcaccucuaucgagugcagaaaauaucuaagguaagcgcaggcaacucauuugucagagacaucguguuccgccaccaucuggaaaccacugugaaagaggucaaggaguugaaagacauuaguuacauccaguuaaagucccuggaagggcucaggaacauuaagaaaguucguaucaaucacauaggaaagauugugcagguaggcgaguauuga

SEQ ID NO: 3304 - RNA, 4221 nt, Artificial Sequence
  Cas9 variant
auggagaagaaaaucauuggcauagaccugggggugaccagcaucggaugggccuacgucauugaagaugagaacggucacuccagaauccucaggauuggcacacggguuaauccccuuacuacggaggaacugaagaacuucgaacaggggaaaccuaucaccgagacagcugagcgcacuuugaagcgaucuaugcguagaaauuuacaaagguauaaacagcggcgcaccaaccugauaaaugugcuacucaagaacaagcugaucacagaaaccacugcacuugccgaggacggaaaaggcacaacccaucugacgcacgcguugagagcuaaggccgcauacgcccagauuccacucgaagauuuugcuaggguacugcugaugcucaauaaaaagcgggguuaucgcucaagucgaaaagugaagacugaggcagacgggcaggccaucgauggaauggcugucgccaagaaauuauacgaggaaaacauuaccccgggccaacugugcuauacacuuuugcugcagggcaagaaaacucuacccgacuucuacagaagcgaucuccagguggagauggaaaagguuuggaccuuucagaaacaauuccaucaggcgauccugacagacgaguuuaggaaguauauagcagggaaaggacagcgggccaccgcugccuccuucugggguaaguacggcuuuaauacggcagaguucaaggggucucgugaagagaaaaagcuaaaaucguacgaauggcgcucacaggcuauuacuacaccucugagccaagaggaaguggccgcggucaucaccgauauuaacaguaauaucgccaacuccucuggauauuugggcgcaaucagcgacagauccaaggagcucuuuuucaauaaacagacugugggucaguaccaauauaaccuguuacagcagaauccacacacaaaccugucagggcagguauuuuacaggcaagauuaucucgacgaguucgaaaccauuugggagacgcaggcuaccuuucauacaaugcuuacucccagucugaaggaagagauacgggauaucguuauuuucuaccagcgaaaguugaaaagccagaagaaacuugugucuaucugugaguucgaaaagcgcauacuggaaccucuccaaggagacaaagucgugggcuauaagguggccccaaaguccucaccccuguuucaggaguucaaaauuuggcaggcucuuggcagaauggagauccagcacaaggucaccaaagaaaggcacuuucuggacuuggaugccaagcaacuccuguucgacgaguuaaacguuaaaggggaucugacaaaggaaaaugcacuaacuauccucggauuuaagccuaaagagugggagugcaaccugcuuaaguuggaagguaaucggaccaaccaggcccuguacgaggcuuaccucaaaauucuggaacuugagggcuaugaagugaaggaccuguuggggcucaaacuggauaaggacgauaucaaauuaagcgagcugccaguagacgcggcagauauuaagaagauggugcgcgagauauucgaaacacuaaauaucaaaaccagucuccuggacuuuaacgccacucuuccgggaaagucuuucgagcagcagcaugcuuaccaauuguggcaucugcucuauuccuacgaaggcgauaauagccccucggguaacaaaaagcugcaggacuuacugcaggccaaauuuggguucacgaaugcacacggccaaauucuugccaacgucucuuuggagacagacuauggaucccucucagcuaaggccaucagaaagaucuuuacccacauuaaagaaaaucacuacagugcagcgugugcucuggccggcuauaaccauagcuccuaccuaucuaaggaggagaaugaacagaggauacugaaagaucgucucacuauccugccuaagaacagccuucggaauccagugguugagaaaauuuugaaccagcugaucaacuuacucaauaccauuuucgacgaucccuaccuggggaagccugacgaaauccgaauagagcuugcaagagaacugaagaaaaacgugcaggagaggcaacgcuugaauacagagaucaccaagaacaauacugaacacgagcggauuacaaaaauccucauuaaggaagauaacaucaaaaauccaacgagaaacgacauaauuagguauaagcuguaccaggagcuaaagcauaauggauauaaaacccuguacucaaacacuuauaucccccgcgaggaacucuuugguaagaauuucgauauugagcacaucauaccgcagaguauccuguucgacgauuccuuuagcaacaaaacacuuugcguccgaaaggaaaauauugacaaagccgaucggaccgcuauggacuucaucggcccuuacuuuggggaggauaaggugcaggaauauauuaaccguguagagauguugcaucaaaucaaucugaaaaaccccgaggaaggaauaggcaaggguaaguacaaaaaguuacucaugaaagccucugagauugggcagggcuucaucgaaagagaccugagggacacacaguacaucgcaaagaaagcucgccagaugcuucuggagguuacucggaccguggucgccacgaccggaucaauuacaaagagacuaagggaagauuggggccucgugaacgucaugcaagagcugaauauggacaaguaucgacagcagggguugacugagcugaucgagaaaaaggauggaaguaccaaagaacgcauuacagacuggacuaagcggaacgaucacagacaccaugcgauggacgccuuaaccauagcuuuuacgaaacacagccauauccaauaccucaauaaccugaaugcaaggaaguccgaugacaagaaagguaaggaaauuuucggcaucgagcagaaagaaacagagaaggugaaagaugacaccgggcagacucagcgucgcuuuaaacuuccaaugccugauuuccggcaagccgcuaagcaccaccuggagcauuugcucauuucuuuuaaagccaagaacaaaguuuucacaaagaauaaaaacaaguauaagaccaaaaauggagaacaggugaagcuggagcuaacucccagaggccagcugcacaaagaaaccaucuacgguaggauaaagaaauauguaacacaugaggagaaggucucgagcaaauuuaacgcacagcuuauccaaacgguggccaauuccaaguaccgauaugcgcuccugaagcgguuggaagagaacgggaaugaccccaaaaaggcuuucaccggcaaaaacucacuggauaagacuccauuauuuguugacgccacacagcaggagaaaauuccuccaguggucaagcucgugaguaucgaacagggauacaccauucgcaaggacaucacaccggaaaauuucaaagaugcaaagucuauagagaaaauuguagacgugggcaucagaaaccugcuucaccauaggcuggagacuuacaacgggaaugaaaaggaggcuuucuauaacuuggauaaaaaucccaucuggguuaacgaaagcaagggaauuuguauaaagcgggucaccaucacgggcgugacaaaugccgagccucuccacuacaaacgagaccaccaugguaagccaauucuggauaacaaugggaacagaacccccgcagacuuuguguccacuggaaauaaccaccaugccgcuaucuaucgcgaugcggccggcaaucuacaagacaacgucguuucauucuacgaagcaguggcuagggugaaucagggucugccuauuaucgauaaaagccuuaacaaggagcucggcuggcaguuucuguucucuuugaaacagaaugagugcuuuguauucccaaacgaaggguuugaccccuuagagauagaucuguauaauccggccaacaacaagcucaucgccgcuaaucuguuccguguccaaaacuuuucccggcuucaguacggaaauaacauuaucagagacuauaauuucaggcacauuuacgaaaccaguguggagaaccgcaaggaacugaaagacaucgcauacaagcagguuaagagcuugccuauauuugagaagauuaucaaagugcgaaucaaucauauuggccaaaucgucaagacaggggaguauuga

SEQ ID NO: 3305 - RNA, 4224 nt, Artificial Sequence
  Cas9 variant
augaucagaaacauucugggccucgaccuuggggugagcuccauaggaugggccuacguccaggaggauucuaaaaauucagaaaacaauaggaucauuaaacuggguguucgggugaaccccuugaccguagacgagcaauuaaauuucgaaaagggcaaaccuaucacaacuaacgcugggcgcacgcuggcacgaagugcccguagaaaucuacagagguuuaagcuccggcgcagcaaccugauggaugugcuuaaaaagaauaacauucugaaggagaccgacuugcucgcggaagucggcaaaaauuccacauuccagacucaggagcugagagcuaagucugccaaagagaagaucgaacugucggaguuugcaagggugcucuuacugauaaacaaaaagcggggauauaagucaagccgcaaagccaagaaugaugaagacggucaaaucguugaugggauggcuguggcaaagaaacuuuucgaggagaacuugaccccaggagaauacaguuaucagcugcuacagcagggcaaaaagcaacucccggacuuuuaccgauccgaucugcaggccgaguucgacaaaauuugggauuuucagaagcaguucaaucccgaaaucuuuacaaacgagcuuuaugaaaagcugcaaggcaaaaacagaaaugcuaccuggaaggaguuggaguucccuuuuucucucgucgggauuaaacagacuggaacaaugcaggaaaagaaaguggagaaguacuucuggaggagcgaagccguaaagaaacaacuggacuuugaguccuuagcgguuguguuccaggaaaucaacucaaaucugaacaauaguagcgguuaucucggcgcaauaucugaucgguccaaggagcuuuacuucuacaaccagaccgucggggaguaucuguuucagcaauugaaaacgaauccacacacuaagcuaaagaaccagguguucuaccgucaggacuaucuggacgaauuugagaagauuugggaaacccagucaaaguaccauaaagagcucacaaaggaacugaaagaggagauccgcgauauuacuaucuucuaucaaagaaaacuuaaaagccagaagggacugaucaguauuugcgaauuugagaauagggaaauagagaucaccgagaacggcaagacuaaaaagaaaaccguggguuugaaggucgcccccaaaucuuccccucucuuccaggaauuuaagauuuggcagguucugaauaacuuacaauuccagaauaucgagacgaaagaaguguuuccaauagaccuggauuucaagcagagcauuuuugacgagguaaacaucaaggggaaacuaucggcuaaggaugugcucgaccuggucggauacucuggcaaagaauggaagacuaauuucaaagagaucgagggcaacuauacaaacgaaaaucuuuacaccgccuuuuugaagauuaucgcauccaaggagauugaauuucccaaagaguucaagauaacuaucgaugacgaaauuaaagugucaaagaucaacgcuagugccgagaucauuaaacuguucguucgggagaaguucagcgaacucgggauagauacauccauccuggacuuuaauccugagcuugaaggaucugauuucgagaagcaggcgagcuaccaacuguggcacuugcucuauucauacgaaggugacgacaguuccagcggcaacgagaaacuguaugaguuacuggaaaauaaguuuggguucaaaaaggagaacucuaaaauucuagccgaaaucggauuuucacaggauuacggcagucucagcuccaaggcaaugcgaaagauuuauccauacaucaaagagcauaaguauucuguggcuuguucguacgccgguuacaaucacagcaaaaacucccugaccaaggagcagcuugaaaaucgcauauugaaagagagacuggacauccucccgaagaacucacugaggaaucccgucguggagaaaauuuuaaaccaaaugaucaaucugguaaacugccuuauugaugaauauagugaaaaggacaaggaugggcagaucguuaaauacuucaaguuugacgagauacggauugaguuggcucgcgaacucaaacugaaugccgaggaaagagcaacgaugaccucugagaucaacaaggccacaauucagcaucagaaauaugcugaagugcuacaaagggaguucggccugaaggcgccuagccguaacgauaucauacgguacaagcucuaucuggagcuugcaaauaacggauuuaaagacuuguacacugaugccaagaucgaacgagagaaucuguucaccgacaaauaugauauugaccacaucauuccacaguccagauuuuucgaugacucauucagcaacaaggucuuagugcccaggaaugcuaaccucaaaaagggcaauuuuacagccuucgacuaccuggaaaucgaggggaaggaaaaacuugagaaguuucugaacauaauuaaagauuuguacgacaagggagcaaucacuaaagccaaguaugagaagcuccagaaaaaggauuucgaaaucggugacggcuuuauugagcgcgaucugcggaauacccaguacaucgcuaaaaagucuaaagaaauucuauucgggauaacaaacuccgucgugaccacaaguggaagaaucacggacaagcugagggaggauuggaaucucauuaacacaaugaaggagcugaaucuugaaaaauaucgcaaguugggccugaccgagacuguuaucaacagcaaaggugaagagaagcaacgaauuaucgacuggaccaaacggaaugaucaccgucaucacgccauggacgcauuaacaguggcguuuaccacucauaaccacauacaguaccucaacuaucugaaugcuagaaaggaugaaaaacacaaggagcaucagaacaucuucgccauugagaaucuuaucacagaaauuaucgacaagaaaaacgggucuaaggagaggcgcuuuaaagaaccuguaaagaaucugcgggcagaggccagaaaacaccuagaugaaauacucauuucccauaaggucaagaacaaagugguuacgaagaauaucaacaaaaucaagaaaaagggcucagugauugcuaagaccgagcugacuccaaggggacaguugcacaaagagacaauauacggcaguagcaaguuccugaaaaccaaggaagagaaaaucucggggaaguuugacgucgaaacaauucaaaaggugcagaaugagcgauaucgcaacgccuuacucaaacggcugcaggaguucggaggugacuccaagaaagcauucacuggcaagaauguaaucucuaaaaaccccauuuuucuuaauaacgaaaagaccgagcaacugccggaaacggugaccuuggcuugguacgagaugggguacacaaucagaaaagccguuaauccugauaacuucaaggacuuuaagaauauagaaaagacuaucgauaagggaauuagggacauccucaccaaacgucugaaggaguucaacggcaacagcaaagaggcguuuucagaucuagacaagaaucccauuuggcugaacaagaguaaagguaucuccauaaaggccgucacaauuacugggaucaauaacgcugaagcacuucauuauaaaaaggaucaccucggcaaagacuuccuggaugagaauggaaagcgcaucgccguggacuuugugucuaccggcaacaaucaccaugucgcuauuuacgaagaugagaacgggaauuugcaggaaaagguugugagcuucuaugaggccguggagcggguaaaccagaaucugccaaucauagacaaagaauacaacuccgagucaggauggaaguuuuuauucacgaugaaacagaaugaaauguuucucuucccuagcgaggacuuuaaccccaaggaaauggaucuguucgacgagaaaaaugucaaccuuauuaguaagaaccuguucagagugcaaaaguuuacaaucaaagauuauuucuuuaggcaccauuuggagaccaauguugaagacucuuccccacucaagggcauuacuuggaaacgagagggucugaacgggaucgaaaauauacuaaaggugcggcugaaccaccuuggaaaaauuguccagaucggcgaguacuga

SEQ ID NO: 3306 - RNA, 4227 nt, Artificial Sequence
  Cas9 variant
augaccaagaacauccugggccucgacgugggggucagcuccauuggaugggcccuuauaaaugaggauaucgaaaaccccaaaaauaacaagauuaucaaacuggguguuagagugaauccuuugacaguagacgagcagauuaacuucgaaaagggcaaaccaaucacuacgaaugcugggaggaccuuagcacggggagcccgccgaaaccugcaacguuuuaagcuaagaagguuccaccucauagauauccugcagaagaauaacauucuuaaacaggcggaccuguuggcugaggugggcaaaaauucuacauuucagacucaagaaauccgggccaaaucagcaaagcagaaagucgagcucagugagcuggcccgcauuuuccugcucaucaacaagaagagagguuacaaaagcuccaggaaggcuaaaaaugaagaugaggggcagauaauugacggaauguuuaucgcaaagaaauuauaugaugaaaagcugaccccgggcgaguacucuuaucagcuuuugaaagagucgaagaagcaacugcccgacuucuaccggucagaucuacagagcgaauuugacaaaauuuggaacuuccagaagcaguuuuauccugagaauuucagugauaaccucuacaaagaacugcaaggcaagaacaaaaaugccacauggaagacccuugagaucccauuuucccugguggggaucaagcagacuggaacauugcaggaaaagaagcucgagaaauauucuuggcgcagcgacgcuguuaagaaacaacuggauuacgagaaguuagccguggucuuccaggaaauuaacuccaauauauacaacucaagugguuaucugggcgcgaucagcgaccgaucuaaggagcucuacuuuaauaaccagaccgugggggaauaucuuuacaaucagauuaaagagaacccccauacgaagcugaaaaaucaaguauucuauagacaggacuacuuggaugaguucgaaaagaucugggagacucaguccaaauaucacaccacacuaacuaaggaacugaaggaggaaauaagggacauuaucaucuuuuaccagcggaaacucaagucacaaaaaggacugauuagcaucugcgaguucgaaaaccgugagauugagauaaaggaaaauggcaaaaucaagaaaaagaccguuggucuuaagguggcaccuaaaaguucuccacuguuucaggaguucaagauuuggcagaucuugaacaaucuccaguuucaaaacaucgaauccaaagagauuuuccccauagaucuggacuuuaaggagagcaucuucaaugaagucaacauuaaagggcgcaucucggccaaggcuguguuagaucugcuaggauacucuggcaaggaguggaacccuaauuuuaaagacauugaaggcaacaauacaaacgagaaucucuauaacgccuaccugaagaucauagcagaugaagaguucgagcuuccaaaagaauuuaaguugaauggggacgaugaccuguauguguccaaaaucgcuuguucagccaguaagauuaaggauuucgucaaagagaaguuuagcgaaaucggaauuaacaccuccauccucgacuucaauccggagcuggaagguaaagacuucgagaagcaggcgucuuaccaguuuuggcaucuucuguauagcuacgagggcgaugacucacagagugggaacgaaaaauuguaugagcuccuggaaaagaaguucggauuuaaaaaggagcacuccaaaauauuaagcaauauuggcuucccccuggauuacgguaaccuaucuacgaaggccaugagaaaaaucauuccucaucucaaggcagggcugucauuugcuaaaaagaguaaggaagacaauauccuuagcgccacugcuauggccggcuacaaccacuccaauucuuauacaaaagaggauuuggcaaagaggguucugaaagagaagcucgaaguguuccccaaaaacucgcugcggaacccaguaguggagaagauauuaaaucaaaugaucaaccuggucaaugaagccguggaggaguacggaaccauugacgaaguucgaaucgagcuugcucgcgaauugaagaaaaacgcggaggaaagagcaaauaugacuagcgagauuggcaaggccacacuccugcaccagaaauaugcugagauccuaaagaaagaauuugauauaccugugccauccaggaacgacauuauccgguacaagcuguaucucgagcuggccaauaacggguacaaggaucuuuauaccgacguccagaucaaacgcgaagaguuguucacgaauaaguacgauauugaccauaucauuccccaaucaagauuuuucgaugacaguuuuucuaacaaagugcugguaccgaggggagcaaauuuaaagaaagccaaccagaccgcuuucgacuaccucgaaaaugaggauaagcagaagcuggagaaauuucuuaacauaaucaagaaucuguaugacaaaggugaaauuacaaaggccaaauacgagaaguugcagaagaaaggcagcgauaucggggaaggauucauugagcgugaccuccgggauacucaauauaucgcaaagaaagcgaaggaaauacuguucggcaucacccacuccguuauuucaacaagcgguaaaaucacugacaagcuacgagaggauuggaaccuggugaacaccaugaaagagcucaaucuggacaaguacaagaaacuuggguugacagaaacccuguuaaacucuaagggcgaggaaaaagagagaauuaucgauugguccaagaggaaugaccaucgccaccacgcuauggaugcccucacugucgcauuuacgacacauaaccacauacaguaucugaauuaccuuaacgcccggaaagacgaggaucauaagcagcacaaggugauuaguaauaucgaaaaccugaucaccaaagucuucgagaagaaaaauggagcuaagcagagaagguuuauugaaccuauaaacaauuuccgcguggacgccaaaaagcaucuagacgagauccucauuagccacaaggcuaaaaacaagguugugacuaaaaauaucaacaagauuaaaaagaagggcucuguagucgcaaaaaccgaacugacaccccgagggcaauugcacaaggagaccaucuauggauccucaaaauuucugaagacuaaagaugagaagauaagugguaaauucgacuuagaaacaaucaauaaggugcagaacgagaaguacaaaaaugcccuccugcagcggcuucgugaauuuggcgaggauagcaagaaagcguucacggggaagaacguuauuucgaaaaacccaaucuaccuggacgaagagaagaccuugcagauuccugaguccgugacucucgccugguaugaaaugaucuacacaauaagaaagcccgucaauccagauaacuuuaaagacuauaagaauauugauaaagugaccgacgagaagaucagggcuguacugacagaucgccuacggaaauucaacggaaauucuaaggaagcauuuagcgaccuggagaagaaccccaucuggcuuaauaaaucaaagggcauugccaucaaaacugugaccauaacggguaugaguaacguugaagcucuccauuacaagaaagaucaccuggggaaggagauuuuggacaagaaaggcgacagaaugccugucgauuucguguccaccggaaauaaccaucacgccgcaaucuaugaggacgcgaagggcaaucugcaagaaaggguggucucuuucuacgaggccguugaacgagugaaccagggguuaagcgugguaaauaaagauuauaacgcuggacucggcuggaaguuucuguucacaaugaaacagaaugagauguuucuuuucccauccgaggacuuuaacccgaaggaaauugaucuguacgacgagaaaaacuugaagcucaucgccaagaaucuguuccgcguccaaaaauuuggugaacuaucaaagagcggguucugguuucggcaccaucuggagaccaguguggauguuaaaaaggaacuuagaaacuacucuuaucucgacuucuacuccaaagauuuuaugaagacuauagugaaggucaggcugaaucacuugggaaaaauugugcagguuggcgaguauuga

SEQ ID NO: 3307 - RNA, 4230 nt, Artificial Sequence
  Cas9 variant
augagcaucauuaacuuccagagaaggggccugauggagacccaagccuccaaucagcucauaucuucacaccuuaagggguaccccaucaaagacuauuuugugggacuggauauugguacaaguagcgucggcugggcuguuacuaacaaggcauacgaauuguuaaaauuccggucccauaagaugugggggucucgccuguuugacgagggagaaucggccguggcgcgacguggcuucagaucaaugaggcggcgccuagagagaaggaaacuccggcugaaacuucuggaagaguuguuugcugaugccauggcacagguagacccuacguucuuuaugcgccuccgagagagcaaguaucacuacgaagauaaaaccacaggucauaguuccaagcacauccuguucauugacaaaaauuauacugaucaggacuacuauaaggccuacccaaccaucuaccaucugagagcugagcucaugaaagaugggacagacgauauaaggaaguuauuucuggcagugcaccacauccuuaaguaucggggaaacuucuuguacgaaggcgccaccuuugacucuaaugcuagcacucuggaugacgucauuaaacaagcccuagagaacaucacauucaauugcuuugacuguaacuccgcgauuucaaguaucggccagauacucauggaggcagggaagaccaaaagcgauaaggccaaagcuauugaacaucugguggacacguauaucgccacugauaccguugacacaucuuccaagacucagaaagaucaggugaaggaggacaagaaacgucuuaaggcauucgcuaaucuggucuugggacucaacgccucacugauugauuuauucgguagcguggaagaacuggaagaggaccucaaaaagcugcaaaucaccggcgauacauacgacgauaaacgcgacgagcuugcgaaggccuggagugacgaaaucuauauuauagaugacugcaagucuguauacgaugcaaucauuuugcuauccaucaaagagccggggcugaccauaagcgaaucgaagguuaaggcuuuuaauaagcacaaagacgaucucgccauucugaagucucuucugaaguccgacagaucaaucuauaacacgauguucaaaguggaugagaagggauugcauaauuacguccacuacaucaaacagggcaggacugaagagacaaguuguaaccgggaggacuuuuauaaguacaccaaaaaggugguggaaggucuccccgauagcaaggacaaagaguauauucuguccgaaaucgaguuacagacucugcuaccucuccagcgaauuaaggauaauggggucauaccauaccaacugcaccuugaagaguugaaaguuauccuggcuaagugcggacccaaauucccuuuucucaacgagguggccgacggcuucucuguagcagaaaagcugauuaaaaugcuugaguuucgcaucccauauuacgugggcccccugaacacacaucacaaugucgauaacgggggauucgccugggcugugagaaaggcgagcgguaggguuaccccuuggaauuuugacgacaagaucgaucgggaaaaaucagcagccgcuuucauuaagaacuugacgaauaaauguaccuaucuccugggcgaggacguguuaccaaagaguucccugcuauacagcgaguuuaugcuccugaacgaacuuaauaacguccgcauagaugggaaaccguuggagaaggccgugaaggaacaucugaucgaggcaguauucaaacaggaccacaagaaaaugacaaagaauagaauugaacaguuucucaaagauaacaauuacauccccgagaagcauaagccugagauuacuggacuggacggcgaaaucaaaaacgauuuagccucuuauagggacaugguucguauacuggguaauaacuucgaucuuucaauggcugaggaaaucauuaccgacaucacaauuuucggggagaguaagaaaauguugcgggaaacucuccgaaauaaguuuagcuccagacuggaugacgaggccaucaaaaagcuaucuaagcugagguaccgcgauuggggccggcucucgagaaaacugcuuaacgugauagagggaugcgacaaggcaggcgacgggaccccagaaacaauuaucauuuugaugaggaacuucagcuauaaucugauggaguuacucggagauaaauuuuccuucauggaacgcauccaagagauaaacgcgaagcugaucgaaggucagauugucaauccccacgacaucauugaugaccuugcucugagcccugccgugaaacgagcagucuggcaggccuugcggaucguggaugagauaguucacauuaagaaaacccucccagcucguaucuuuguggagguaacuagaaguaacaaggccgaaaagaaaaagaaagacucuaggcagaagcgccugagcgaucuauacgcagcuaucaaaaaggacgaugcccugcucuccggccugacgaaugaggaguucgggggacuuaagucaggcuuggcgaaauaugacgaugccgcucugcggagcaagaaauuauaccucuauuacacacaaauggguagaugugcauacaccggggaggucauugaccugucucagcuuaacacugacaauuaugauaucgaccauauuuaccccaggucccugaccaaggaugacaguuuugauaaccuagugcucugcaaacgaacagccaaugcucagaagucagacaccuauccgauaucuaaggagauccagaaagcccaaaaggcauucuggauuuuucugaaacagcagggcuugaucuccgaacgcaaguacgagcggcugacuagaauuacaccuuuaacggcggaugaccucucaggauucaucgccaggcagcugguugaaaccaaccaaagugugaaagcugccacuacacuucugcgucgcuuguaucccggcgucgaugugguauuugugaaggcagagaauguuaccgacuuccggcacgauaacgacuuuauaaaggucagaagccucaaucaucaccaccaugcuaaagaugccuaccugaacaucgugguggggaaugucuaucacgaaagguucacacgaaacuuccgggcauuuuucaagaaaaacggagccaaucgcacuuacaaccuagcuaagauguuuaauuacgacguuaacuguaccaaugcgaaagacgguaaggccugggaugugaagacgucgauggacaccgugaaaaagaugauggcauccaacgauguaagagucacaaaaaggcugcuugagcagucuggcgcucucgccgacgccacuguguauaaggcugcaguugccgagaaagcgaaggauggggcuuacauuggaaugaaaaccaagagcucaguguucgccgacgucaguaaguauggcgguaugacaaaaaucaagaaugcauacuccauuaucgugcaguaugccgggaaaaagggcgaaguugugaaagagauaguaccacugccuauuuacuugacuaaccggaauaccacggaucaggaccugaucgauuaugucgcuucuaucauuccccaagcaaaggacauaagcaucauuuaccgaaaguuaugcaucaaccagcucgugaaagugaauggauuuuacuauuaccugggcgggaagacaaacuccaaauucuguauugauaaugccauccaggucauaguuucaaacgaauggaucccauaucuuaaggugcuggagaaauuuaauaacaugagaaaggacaacaaggauuugaaagcgaauguaauuagcacccgcgcucucgacaacaagcauacuaucgaagugaggauugucgaggagaaaaauaucgaguucuuugacuaccuggugaguaagcuaaaaaugcccauauaucaaaagaugaagggaaacaaagccgcagaacugucugaaaagggcuacggucuuuucaaaaagaugucccucgaggaacagagcauucaccugaucgaguuguuaaaucugcucacaaaccagaaaaccacuuuugagguuaagccucuggggaucaccgccucgcguucaacagugggaucuaaaauuaguaaucaggaugaguucaaggucaucaacgaauccauaacgggccuuuauagcaaugaagugaccauuguuuga

SEQ ID NO: 3308 - RNA, 4233 nt, Artificial Sequence
  Cas9 variant
augaccaagaacauccugggccucgaccuuggggugagcuccauuggaugggcccugguccaggaaaauucuaaaaaccccgaaaauaacaagauaguuaaauugggugugagaguaaauccuuuaacaguggaugagcaaaucaacuucgaaaagggcaaaccaauuacuacgaaugcuucaaggacccuggcacggagugcccgccgaaaccuacagcguuuuaagcucagaagggcgaaucugaucgacguccuuaagaaagggaacauucugaagcagggagauuugcucacagagaucggcaaaaauagcacuuuccagacccaagaacugcgggcuaaguccgccaaagagaagguggagcugucugacuuuguucgcauacucuuacugaucaacaagaaaagagguuacaagucgucaaggaaagcaaagaaugaagaugaggggcagauuaucgacggaauggccguggcuaaaaaguuguaugaagagaacauuacaccgggcgaguacagcuauaaacuucugcaggaaggccggaagcagcuacccgauuucuaccgcagugaccuccaagcagaguuugauaagaucuggaauuuccagaaacaguuuaacccugaaauauucaccaacgagcuguauaagcgacuucaggggaaaaauagaaacgccacuuggaaggaacuggagauuccauuuuacuuggucggaaucaaacaaauugguacaaugcaggagaagaagaucgaaagguauuucuggcgguccgaggcugugaaaaagcagcucgacuuugaaucucuggccguaguuuuccaagagaucaauagcaacuuaaauaacuccucaggcuaccugggggcgauuagugaucguagcaaagaacucuacuuuaauaaccagaccgugggagaguaucuuuacaaucagcugaagauaaacccccacacgaaauugaagaaucaggucuucuaucgccaagacuaccuagaugaguucgaaaagaucugggagacucaggcaaaauaucauaagaaacugaccaaggaacucaaagaggaaauuagagacaucgugauauuuuaccagaggaagcugaagucucagaaaggccuuauuuccuucugcgaguuugagaaccgggaaaucgagaucacagugaaugguaagacuaaaaagaaaaccgucgggcugaagguugugccucgaucaagcccauuguuccaagaauuuaaaauuuggcagcgccucaacgaccuggaguucaagaauguagagacaaaggaaaucuuucccuuagagcuggaacacaaagagauucuauucggaaaccucaacauaaagggcaaucugaguucuaaagaacuuaucgagcaguugggcuauccuuccaaggaguggaaauguaacuuuaaggaaauugaugggaauaagacccaugagaaccuguacacggccuuccucaaaaucaucgcuaaugaaggaauugaguuuccaaaggaguucaaacugagcauagacgaugacaucaaggugucgaaaauugaugucucuuccgagaagaucaaggaguuuauuaaagaaaacuuccuuaagcuggguaucaauacuucaauauuggacuucaacccggagcucgauggcaaagacuuugaaaagcaggagaguuaccaacuguggcacuuacuguauagcuacgaaggggaugacuccgccucuggaaaugagaaacuauaugagcuccuggaaaagaaguucggcuuuaaaagagaguacagcaagauccuugcagauguggguuucucacaggacuaugggaguuuguccagcaaagcuaugaggaagauuuuuacauacaucaaagaaaacaaguauucugaggccugccaucuggcgggcuacaaucacaguaaaaacagucucaccaaggagcagcuggccaaucggauuuuaaaggaacagcuggagauccuucccaaaaacgcauugcgcaauccuguuguggaaaagauacucaaccaaaugauuaaccuggucaaugaggugaucaaagaauacggaaagccagacgagauuagaaucgagcuagcuagggaacugaaaaagaacgccgaggaacgugcuaauaugacuagcgauauauccaaggccacacuccugcaccagaaauaugcagagguacuucagaaggaguucggcaucaaagcccccucucggaacgacauuauccgauacaaguuguaucuggaauuagcuaauaacggguacaaagaucucuauaccaaucaaaagauugagaaggaaaacaucuuuacggacaaauacgauauagaccauauuaucccucagucgagauucuuugaugacagcuucuccaauaagguucuggugccaaggugugcgaaccaggauaaagacaauuauaccgcagucgauuacaucgagaagaaauacggagaacgcgguaaggaggacuuucuuaaccggauucaccugguguucaagucaaaagaagccaucgcuggcaagagugagucucagauuagcuccaugaauacaaaauuuuugaagcuccagaaaaaggggucagagauaggagaaggcuucaucgagagagaucugagggacacucaauauauugccaagaaagcaaaggaaauccuauucgguauuaccaacagcgucaucucuacauccgggcgcauaacugacaaacugcgagaggauuggaaucucgugaacaccaugaaggagcugaaccuugaaaaauaccggaaguugggccugacagaguuaaucgccaauaguaaaggagaagagaaggaacguauuaucgacuggaccaagagaaacgaucauaggcaccacgcuauggacgcccucacuguugcauuuacgacacauaaucacauucaguaucugaacuaccuuaaugcgcgcaaagaugagaagcauaaagagcaccauaacaucuucgcuauagaaaauauuaucaccgagaucguggaaaagaaaaacggcagcaaggagcggagauuuaagcugcccauuaaaaauuucaggacugaagccaagaaacagcuagaggagguacucauaucucacaaggccaaaaacaaggucgugaccaagaauaucaacaaaacaaagaaaaagggaggaguuguguccaaaauuguccugaccccgcgaggucaauugcacaaggaaacuaucuauggcucagcaaaguuucugaaaacaaaggaggagaaaauuagugggaaguucgacuuagaaacgaucaauaaagugcagaacgaaaaguuuaaaaaugcucuccuggaucgccuuaaggaguucaacggagacagcaagaaagccuuuaccggcaagaauguaccugcuaaaaaccccauauaccugaacgagcagaagacugaacaggugccagagucgguugucuuggcaugguaugaaacagguuacaccauccggaaagccgugaaugcggauaacuucaaggacuacaagaaucucgagaaaauuaucgauaagggggugaaagagauucugaagaacagacuaaaugccuuuaacggcaaugcuaaagaagcauucuccgaccuggagaagaagccuaucuggcuuaaccaaucuaaaggaauagccgucaagacaguuacuauuaccggcaucaauaacgcugaaacgcuccauuauaaaaaggaucacuucgggaaugagcuguuggacgaaaacgggaaaaagauccccguggacuuugugagcaccggcaauaaccaucacguagccauuuacgaggaugcagacgguaaucugcaggagagggucgugucauucuaugaagcgguugagcgugugaaccagggguuaaguaucauagauaaggaauacaaccaagaccucggauggaaauuucuguucacaaugaagcagaaugagauguuucuuuucccauccgaagauuuuaaccccaaagagacugaccuguucgaugagaagaauuugaaccucauuucuaaaaauauguuucgcguccagaaguucggcagccugcuauccgguuuuugguuccggcaccaucuggaaaccacaguggaccuuaacucaagccucaaagauacuucauauaagguuauccagucuugcaauaaccugaaguugauugugaaaguaagauuaaaucaccugggcaagaucguccaaauaggggaguacuga

SEQ ID NO: 3309 - RNA, 4236 nt, Artificial Sequence
  Cas9 variant
auggugaagaaagaguacuucaucggccuggacauggggaccagcuccgucggaugggccguugcugauacaaacuauaaucuccuuagagcaaaggguaaagacauguggggcgugaggcuguuucccgaagccucuacugcggcugaucggcgcucacaccgaacggcccguagaaacaauaagaggaaagcagcccgggagggguucuugcgcgaaauuuuugaggacgaaauaaacaagaucgauccuggauucuuugagagauuaaaggagaguaaauacuaucuggaagacaagcuaaccgauacaccauucguacucuuugcugacaaaggcuacacugauaaggaguauuacgacgaauauccgaccguguuccaucugauuaaagagcuuaucagcgagaagggucuggaaccccacgauauuagguuggucuaccucgcaugccugaauaucuacaagcaucgggggcacuuucugaacgacacacucuccggagauggcauagacaauaucaacucuuuauguaaugacuucaccucguaucuggccgauuacaaccaaaauucagaggacgauggcacugagaaaauggaccuugauagcacaguguuggcugggguuuuugaggaaacccugugcaacaagcaucuaaguaauuccgccaaaaagcgcgaccucauugauaaacugggaaucacgaacaagacuaaauaucuuaccgagaugauggcgcugauuucugguuuggcaagcuccgugucaaauauguucgccaaggacacauacgaugaggaacagaagaaauuuaagcucaguuuccgaagcucuaaccuggacgaggauauggucaaagugcaggcuauguuaacuccugaagaguaugaaaugaucuguauaaugaagaaaauucacgacugguccguaguuucagugaucaugggcagccacaaguacauuagugacgccagagucgagcuguaugagaagcauaaacaggaucucgcaaaacuuaaagcuaucuacaaggaauaccugccagacaaauaugaugccauguucagggagaugaccgacaacucuuacuccgcguauguggggaaggugagcucgaauaagaaaucucagacaggaaaccacaagguccggaugcaacgucgcggcgccaaaugcaagcaggaagauuuuuacgacagaaucaaaaaggagauuaauuccguuccccaggaagagaagauagauaucuugcaggacauggagaccaacucauuccuaccuaaacaacugacgaaugaaaacggugugauuccauaucagcuccaucuggcagagcuuaagaaaauccuggauaaugcuaguacuuacuugcccuuucucaacagcgccgacgaaacagggauauccaauaaggauaaaauuauccagcuguucgaguuuaggaucccuuauuacguaggaccauuauucaagucugagaaaaacaagaccaaugcuugggugguccggaaggaaagcggcaaaguguacccguggaacuuuaaugagaagauugacgaaaaacagucagccgagaucuucauugaacgaaugguucgccacuguacuuaucugaacaaugagagugcacuacccaagaacucccucaaauacgagagauuuagggugcugaacgaacuuaauaacuugcggauaaauggcgagcgcaucagcccugaacugaagcaaagaauuuauaacgaacucuucaaggucaaaaagaaaaggaucacaaagucuaugcugugcgaauaccuuuauaaaaaugggaucgccgauaaggacucagagcugaguggauuugacgguaccuucgcuaacgcguugcucagcuacggcaaguuucgugagcuguucaauguggauacguuaaccgacaaacaggaagcagccgcugaggauauuauaaagugguccacaguauauggggacucuaaaaaguuccugcaggagaaaaucgaagaaaacuacggaccagagucggagaauccccuacucgauaacaagcaaauuaagcggguuaugggcuacaaauuuacugacugggguaaucugagccgagaguuccuuaacuuggaaggggccgauaaggacaaugauaccacaacuggcgaagugaugccucugaucaccagaaugugggaggagaacuauaaucucauggaacugauguccaacaaauuuucauacagggacgcauuagccgagaagacagaagagauugagaaaacccugacugauaucgaauaugaggaccuugaagauuuguacauaagugcuccagucaagcgcaugacguggcagacacuccugauccuaaaagagauuuaucagaucaugggauacgcccccaagaagauuuucguggaaauggcacgggaggaagaggagaaagucaacggcaagggggcgagaaaaucuagcaggaagaaacgccuggaagaccucuaucgaaauuguaaggacgcuuccaaggagcugucaaccggaaucaaaaacgccgaugaagcaauacuucggcguaagaaauuguaccuguacuauuuacagaaggguaaaugcauguacagcggcaagacuauugacuuuaagucucucuucaccaauaacuaugauaucgaccacauuuacccgcaauccgugguuaaagaugacagucuggagaauaacauggugcuuguagaaagaaauuauaacaauaagaaaagcgauacauuuccuaucuucucugacuggcagaacaagaugaaacccuuuuggaccaugcugaaggagcagggguucauaaaugaggaaaaguacaaaagguugacucgcacagaugagcucacggacgaugaacuggccaacuuugucaaucggcagcuaguggagaccagacaagcuacuaagguuaucgccgagcugcucaaaaacuccuucgacgacauugauucaaagaucguguaugcaaaagcuggaaaugucagugaauuuaggcauaaguucagcaugaaguacgacaaagagacagaaaagucguccgugauucacccagagcugguaaaaugucgaaucauaaacgauuuccaucacgccaacgacucuuaccuuaauauugugguuggcaacaucuaugaugucaaguuuacccagaauccuuacaacuauaucaaagaauacaagaaacagaagaauaacagcgcguugucagagcaggagaaggaaaaauaucauauggacaagauuuucaauuuugaugugaaacgcaacggugagguggccuggaucaguagaggggacaauaagacacuggaaacugucuuaaaaguuaugcggaagaacacccccauugugacgaggaugaauuucgaggaacacggccaacucgcugaucugaccauauacuccgcaucugacgcccuuagcaagaaaggagugggcuauaucaagguaaaggcuuccgaugcccgucuggacguccuaaaguacgggggauacaaaaaguauaagggugcauacuuuuuccucguggagcacacagagaaaaacaagcgcguucggacuauugaaaauaugccacuguauuugaaaaacgagcugaauaccaaggagaaaaucgaauuauggugcgcggauaaggaaaacggccucgggcugguggaccccgacgucagacuuggaaagauuaaacuguacucaaagaucaggauagauggcuuugacuuguaucucacaggucgaacugggaauaaccugcuaaccagcaacgccgugcagcugaaaaucggcaguaauaagccuucugauaacgacaaacuuuucuggcgguacuauauuaauaagcucuccaaauacacggagaacagcgaguuuguuucgauccagaauaacauuaagcuguacgauuuguucguggaaaucaauaacgcuggaguauauucaaagcgccagaauccaauaggcgacaaacuguuagaggggagaucuaaguuuauuaaccucacacugaguaaacaagucgaaacccuucugggaaucaucaggauuuacuccuuggagaaucagggcgccgaucucagcaacauaggugggcaggagaagaauggaacuaugaaaccgcauaagcggaucucugacaagaaagaagugcugcuaauuaaccaaagcgugacaggccuguaugaguccaagaucgaucuucucaaaauuuga

SEQ ID NO: 3310 - RNA, 4236 nt, Artificial Sequence
  Cas9 variant
augaagaacauccugggccucgaccuugggaccaauagcauuggaugggcccugauaaaacagaacgcugaggaaagacaagguuccaucuugggcauggggacaaggguguuacccaugucucaggauguccugggagacuucggcaaggguaauucaguuagucagacugcagcccggacgggguaccgcggcauucgacgucuaagagagagguuucuccugcggcgcgaaagacuucacagggugcugaacaucuugggauuccucccuuauuacuaugcggcucagauugauuuugacaaacgguucggcaaguuuaaagccgagaccgaaccaaagcugccguacaauaacgagggguucaucuuuaagaauagcuucgaggaaaugcuguccgauuuuaaaauaucucaacccgagcucuuaucgggaaacaagaaaguaccuuaugacuggacaaucuacuaucugcgcaagaaagcagugucacagaagauugaaaaggaggagcuugccuggaucuugcugaauuucaaccagaaacgagguuacuaccagcuaagaggcgaagauuuugacgaggaaaaggauaaaacuuucgucacccucaauguggacaagguuauugauagcggggagaaagugaagggaaacauccuguuugacauauauuucacaaauggcuggaaauacgaaaagcaaaccacuaagccagaggauuggcuugguaggaguaaagaguucauuaucacagaaucccuguugaagaacggggagguccggcguaccuuuaaagcuguggacucugaaaaggacuggauugcaaucaaagccaagacggagcaggaaaucgagacugcucauaagaccguaggaagcuauauuuacgaugccauacuccagaaucccaaacagaagaucaaaggcaagcugguucgcacaauugagagaaaauucuauaaggaagaguuaaggaagauccuggaaaaacaaaaggacuuucaccucgagcuucagaacgaagaucuguacuccgacugcgugcgggaguuguaucgaaacaaugauacucaucagcuaucacuggcgaaaaagaguuucauacaccucuuucuggaggacauuaucuucuaccaacgcccucuuaaaagccagaagucuuccgucucaaacuguacccuggaaugcagaaaguacagggauaaaaauggcgcagaggggauccaguuuuugaaggugauuccaaaaagcaaccccuauuaccaggaguuccggaucuggcaauggaugaguaaucucaagauuuaucgcagagacgaugacgugaacauaacaucugaaugucugaaaaccgccgaggauuacgaagacuuauuugucuuccugaauaucaggaaggagguugaccagaaagcaugccuacgucauuuuaagcucuccgaaaagacgcaccgguggaacuauguggaggauaaaaaguacccuuguaaugaaacuggaacaaugauuagcgagcgacugaaaaagguaggugacucgccagauaacaucuucaccagagagauggaacagcagaucuggcacauuauauauucugugaaugacaaaacugaguacgaaaaggcccuuaaguccuuugcuaaaaagaacgaguuggauaaugacucauucuucgaggcuuuuaggaaauucccgcccuuugauagugaauacggcagcuucuccgagaaggccaucaaaaagcugcucccucugaugcgcauugggaagcauuggaacugggaagcggucgacgagaaaaucaagaaucggauucagaaaaucauaaucggagaauaugaugagaacauuaaggacaacaucagagagaaaacacuuucucugcaaaaggaaagcgauuuucagggcuugccacucuggcuggcccaguacgugguuuaugguaggcacucagaggcaaguguggcugggaaguggaacuccgucgacgauauugaagaguacuuaaaagaguucaagcaacauagccugcgcaaucccaucguggaacagguaauaauggagaccguucgaguggucaaagacauuuggaucaaguauggcaauggagccgcugacuuuuucgaugaaauucacaucgagcuaggccgggaaaugaaacucccugccaaggagcguaacaaaaugacgcagaagauaucugaaaaugagaacaccaaucugagaaucaaggcacuuuuggccgagaugaugaacgacucagaagugcagaaugucaggccauacagucccaugcaacaggagauucugaaaaucuaugaagauggggcucucaacagcgagauuuccguggacgaugacauccugaagauaucuaaaacagcgcagccgucgccuagcgauuuaaagaaauacaagcuguggcuugaacaaaaguaccgcucccccuauacuggagacauuaucccauugaauaaacucuuuaccacagaguacgagaucgaacacauuaucccucagucacgguauuucgaugacaguuuuucuaacaagguuauuugcgagagccuggugaauagacuaaaagauaacuacauaggucugggcuucaucaagcaguuucauggguauaaaauuuccgacaagacuaagguauucgaagucgaggaauacgaggauuucgugaaaaagaauuaugcaaacaacaggucaaaacgaagcaagcuccugcuugaggaaauccccgaggaaaugauugagcgccaguugaaugacacccgguacaucucuaaauacauauccggaauccugaguaacauuguuagaaagaaggagaaugacgaaggcgugaacagcaaagauaucauuccagguaaugggaagaucacaucucaauuaaaacaggacuggggccucaacgaugucuggaaugaccugauacuucccagguuugagcguaugaacgaacugaccaaguccucauauuucacuguguggaaugagaaauaccagaaguuuuugccuacgguaccaguggaguucaguaagggauuuagcaaaaagcgcauugaucaccggcaucacgcccucgacgcucugguuaucgccugugcaacaaaagaucaugucaaccuacugaauaacaagucggccaaauccgaaaugaagagauaugaccucaaaaggaagcugaugaaguucgagaaaaagaccuaccagcacucucaaacuggcgaacgaaucgugaaagaugugccggucgaguuucuuaagcccuggaaugacuucaccguugaagcuaaagagaacuuggaaaagauuauagugagcuuuaagcagaaucugcgggugaucaacaaagccacaaaccacuaugagaaguggauugagaaagauaauguaaaggucaaaggguuaguggaacagcagggacucaacugggcaauccgcaagccucugcauaaggacaccguuucagguaaaguggaccuuccaggcauuaagguccccaaagggaagauccugacugcgacaagaaaaaguauagauacguccuucgaccuaaagaccaucaauucuauuacugauacaggagugcaaaagauccucaaaaacuaccuggaguauaagggcaauagcuccgaagaggcuuuuucaagcgaagguauugaggacaugaacaauaacaucgagaaauucaaugaagggaaguugcaccagccuauaaccaaaguuaggauuuucgagcugggcaguaaguuuccauuaggacagaucggcaacaaaaagcauaaguacguggaaacagccaaagggacuaaucucuucuuugcaaucuacgaggaugacaagggaaaacggaccuaugagacgauuccccugaacgaaguaaucgagcgacaaaagcagggccuugccccggucacccugaaaucuaagaaugauuucuacuugugcccuaacgaccucguguauguggcugccgaaggugaguccgucaauaagauagauuuuaaauacgcaagccaggaauuuauucacaacaucuauaagguugugucguucucagggucucagauuuucuuuguaaaacaaaauaucgcugugaguauagucaacaaggccgaguucuccacacugaacaaaauggagagagcgguggacggaaagaugauuaaggauuguugcaucaaacuaaagaucgaccgcauuggcaauaucacuaaaagcuga

SEQ ID NO: 3311 - RNA, 4239 nt, Artificial Sequence
  Cas9 variant
augaugaccaagaacauccugggccucgaccuugggacaaauagcauuggaugggcccugauaaaacagaacgcugaggaaagaaaggguuccaucuugggcauggggacuaggguguuacccaugucucaagaugcacugggagacuucggcaaagguaauucagucagucagacggccgcgcggaccggguaccgcggaguucgacgucuaagagagagguuucuccugcggcgcgaaagacuucacagggugcugaacauuuugggcuuccucccugauuauuacgcugcccagaucgacuuugauaagcgguucggcaaauuuaaggcagagacagaaccaaagcugccguauaauaacgagggguucauuuuuaaaaauagcuucgaggaaaugcuguccgacuuuaagaucucucagcccgagcucuuaucggaaaacaaaaagauaccuuacgauuggacuaucuauuaccugcgcaaaaaggccguaucacaacgaauugagaaggaggaacuuguguggaucuugcugaauuucaaccagaaaagaggauauuaccagcuaaggggugaggacuuugaugaagagaaggacaaaaccuucgucacacucaauguggauaagguuauugacagcggcgaaaaagugaaggggaucguccuguuugauguguacuucaccaacggauggaaauaugagaagcagauaacuaagccagaggacuggcuuggccggaguaaagaguucauuaucacagagucccuguugaagaauggugaaguaaaacguaccuuuaaggcuguugacucugagaaagauuggauugcaaucaaggccaagacggaacaagagaucgagauugcucauaaaacuguggggagcuacauauaugacgccauccuccagaaccccaagcagaaaauuaagggaaaacugauccgcaccauagaaagaaaguucuacaaggaggaauuaaggaaaauucuggagaagcagaaagaauuucacccugagcuccaaaaugaggaucuuuauuccgacugcguccgggaacuguaccgaaacaacgaugcgcaucaguugucacuagcaaagaaagacuucauccaccuguuuguggaggauaucauuuucuaucagcgcccacucaagagucaaaagagcucuguguccaauuguacacuggaaugcagaaaauacaaggacaaaaacggcgaggagaggauccaguuucuuaaggucauucccaaaucaaauccuuacuaucaggaguuccggauauggcaguggaugagcaaccugaagaucuaccgcagagaugacgauguuaauauuaccagugaauauuugaaaacuacagaagacuaccaagaccucuuuguguuccugaacaccaggaaggagguagaucagaaggccuguuuaaaacauuuuaagcugaaugagaaaacgcaccguuggaacuauguggaagacaagcgguacccaugcaaugagacuggcacaaugauccuagaacgauucaaaaaggucggggauucugcugacaacaucuuuaccagagagauggaacagcagauguggcacauuauauauuccgugaaugauaagacugaguacgaaaaagcccucaagagcuucgcuaaaaagaacgaccuggauaauguuucguucuuugaggcuuucaggaaauuuccgcccuucgacucugaguacggauccuuuucagaaaaggccaucaagaaacuuuugccucugauucgcacagguaaguauuggaacugggaggcgguggaugagaaaaccaagaaacggauccaaaagaugauuacgggcgaaugggacgaagauaucaaggacaauauaagagagaaaacccucagucugcagaaggagagcgauuuccaggggcuuccacugugguuggcccaguacgcagucuauggaaggcauuccgaagcaucuguggccggcaaauggaacagcguaaacgacauggaggaauaccucaaggaguuuaaacaacacucacugcgcaaucccaucguugaacaggugauuacagaaacuauccgagucgugaaggacauuuggaucaaauaugguaacggggcugccgauuucuuuaaugagauacauauugaauuaggccgggagaugaagcugccugcaaaggaacguaguaaaaugacccagaagaucuccgagaacgagaauacaaaccuaagaauuaaagcccuccuggucgaaaugaugaaugacagcgaggugcacaacguuaggccauacucucccaugcagcaagaaauccuuaagauauaugaggauggagcucuuaauucagaaaucaguguggacgaugacauucugaaaaucagcaagacugcgcagccguccccuucugaucucaagaaauacaagcugugguuagagcagaaauaccgcucgcccuauaccggcgacauuaucccacugaacaaguuguucacaaccgaguacgaaauagagcacauuaucccucaaagccgguauuuugaugacuccuucucaaauaaaguaaucugugaaaguucugucaacagauugaaggauaauuacauugggcucggauuuaucaagcaguuccaugguuauaaaauuagcgacaagacuaaaguguucgagguugaagaguacgaggauuuugugaagaaaaacuaugcauccaauuggucaaagaggagcaagcugcuacuggaagagauacccgaagagaugaucgagcgacagcucaacgacacgcgcuacauuucuaaauacaucuccggcauucugaguaacaucguccggaagaaagaaaaugacgauggggugaacagcaaggacauaaucccaggaaauggcaaaauuacaucucagcuuaagcaagauugggguuugaacgacguauggaaugaucugguguuacccagauucgagaggaugaacgaacucaccaaguccaaugacuuuacuguuuggaacgagaaauaucagaaguuccugccuaccgucccaguggaauuuucaaaaggguucaguaagaaacguaucgaucaccgccaucacgcccuugacgcucuggugauugccugcgcaacacgggaucaugucaauuugcucaacaaucagagcgccagaucggagaugaagagguacgaccugaaacgaaagcuaaugaaguuugagaaaaaggcuuaucagcacucccaaaccggcgaacggaucguuaaagaugugccgguggaguuccugaagcccugggacaacuuuauaguagaagccaaagagaaucucgaccgcauuaucgucucuuucaagcagaaccugagagugaucaauaaggcaacuaaccacuacgaaaaauggauugagaagaacaauguuaaagugaaggcgcuugucgagcagcagggauugaacugggcuauaaggaaaccucugcauaaggauacagugagcggcaagguugacuuaccagggacgaaagugcccaagggaaaaauccucaccgccacucggaagucaauugauacaaguuuugacaugaaaaccaucaauuccauuacagauacugguauccaaaagauacugaagaacuaucuugaauacaaaggcucuuaugaggacgcauucagcccugaagggaucgaggauaugaauaagaacauugaaaaauucaaugacggaaagcagcaccagccaaucauuaaaguacgaaucuuugagcugggcuccaaguucccccuaggucaaauagggaacaaaaagcauaaguacgucgagaccgccaaaggcacgaaucucuuuuucgcuauuuacgaagaugacaagggaaaaagaaccuaugagacaaucccgcugaacgaagugaucgagcgccagaagcagggcuuggccccugugacuuuuaaaucaaagaaugauuucuaccugagcccaaacgacuuagucuauguugcagcugagggggaaaguguggauaaucucgacuuucagucugacucccaagaguacauuaacaauguauauaagguggucagcuucucgggaucacagaucuuuuucgugaaacagaacguugccgugucuauagucaauaaggcggaauuuaguacccugaacaaaauggagagggccauugauggccguaugaucaaggaauguugcgugaaacuuaagauugaccggaucgguaacaugacaaaguccuga

SEQ ID NO: 3312 - RNA, 4245 nt, Artificial Sequence
  Cas9 variant
augaagaaaauccugggccucgaccuugggaccaacagcauuggaugggccuucguggaggaagcugagaaugaauccgagaagucuucaauaaucaaacugggugucagaguuaaccccuugacaguggaugaacagcaaaauuuugagaagggcaaaaguauuacuacgaacgcagacaggaccuuaaagcggagcaugcgccgaaaucugcagcguuacaagcagagaagggagaaccuaaucgauauucucaugaaaaauggguucacauccgacgauacuauccugucugaaaacggaaaucggaccacauuugagaccuaucgccuuagaucgaaggccguagcggaaaagauaucacugcaggaguucgcuaggguguugcucaugaucaacaagaaacggggcuacaagagcagucgcaaggccaaagguacugaggacggggaacugauugauggaauggaggucgcaaagaaacuguauaauuacaaccucacaccuggccaauuaugccugcagcuuuugaaugaaggcaagaaacaucugccagacuuuuaucgauccgaucuacaggccgaguucgacagaaucuuugauauucagaugaccuucuacacggaauaucucacucuggagcuuaaggaggaacugagggggaaaaagcgggacgcugugugggcaaucugugccaagauauuuaaagagaagggauucgaauugauugguaccaaacgucaaggcucuacagcugagcagaagcacgaaaacuacagcuggcgcgccaaagggcucuccgagaagcuggaguuagaacagcugguugugguccuccagcaaaucaauauucagcuuaacucaaguagcggauaccugggcgcgaucucugauagauccaaggaguuguuuuucaacaaacagacugugggucaauaucagauggcaguacuagacaagaauccgaacgccgggcugaggaauaugguuuucuaccggcaggacuaucucgaugaauuuaacgcuaucugggagaaacaggcccuguuccaccccauucuuaccgacacacugaaggaugaaauacgagacgugaucaucuuuuaccaacgcagauugaaaucacagaagggacucauuagcuucugcgagcuggagaguaggaagauagaagucgagauugcaggccagaauaaaaccaagauggugggcucucgggugaucccucgcuccagcccauuauuucaggaguucaaaaucuggcaaucgcugaacaauauugaagucuuugggaaggguaaaaagucuaagaaacagaaggagcagacgcuauucgaucagacugaagacccccucgaguuuggaggcagaagggaacuguaugaggaagagaaagagcuuuuggcucuggaacucuccaucaagaaagagcugaagaaagccgauauucuuaagcuguuguucgacaacccuaaggaacucgaucugaauuuuaacgcgguucaagggaauuuaacacaggccacccuguucaacguguacaaaaagauaaucgagcuaucaggacaugaaauugacguagagaaagauagugcaagcaagauccucaaauccaucgaggaaauuuuuaaggcucugaauuauaacacugagauacuucacuucgacucugaaaagagccaggaccagcaagccauguacauguuguggcaucugcucuacucauuugagggcgauaauaguaacacagguaacgaaaaucugaucaacaaaauuuccaaguuauauggguucgagaaagaguacgcuaagauccuggccaaugugagcuuccaggacgauuauggcucucuuucagcaaaagccauuaguaagaucuugccauaccucaaggaaggacacaaaagcgacauagcuugugaucuggcgggcuauaagcacuccgcaucuucgcuaacccgugaggaacuggagaacaaaacguacaaggaccggcucgagauccugcccaaaaauacccuucgaaacccugucguggaaaagauuuugaaucagaugaucaacguuauuaaucugaucauagauagcagagaguuaaagaaauccgccaaggaaagggaggaacucacaaaaucaauuagugagacuaccaagcugcaucaacaguauaaagacauccuugcuaaggccccauuuaaccugacaaauacuucucgcaacgauauuauccgguacaaauuguacgaggaacucaaggacaauggguauaagacccuguacagcaacaaauauauauccccggcagcccuauucucaggagauuuugacaucgagcacauuaucccccagagcagacuguucgaugacucuuuuuccaauaagacacucgaacugaggaguauuaacaucgagaaagguaacaagaccgcuuacgacuucauaaaaggcaaguauggggaaacuggagaggauaauugccuugacaaguacuugaaccgcauugagacgcuguauaaaaauggcaucuuaaagaaaagcaaguacaacaaacucaagaugcaggauaaggacaucccugaugguuuuauugaacgagacauccgggauacacaauacauugccaaauaugcaaagacccugcuuggggaccuggugaaauucgucgugucuacuuccggcucaguaaccgagcgucuaagagaagauuggcagcucguugacgugaugaaggagcugaauugggaaaaauacaugcaguugggacugacagaggaguuuaccaacgaagagggccauaggauacgcaagaucaaggauuggacuaaacggaaugaccacagacaccaugcgauggaugcuuuaacagucgccuucacgaagaggcaguuuauucaauaucucaacaaucugaacgcacgacgcaucagugacgaacaggggauuagcaauucggagaaagacgagcggaacaauguguccaucaccacuaacgauaugaaacuuaauacaagagacguccugggaauagagaaaaaggaauuguacagggauaaccgugguaagcuccgcuucaaagccccaaugccccugcuagaauuucgggaggaagcuaagagacaccuggagaacacccuuaucucuauuaaagccaagaauaaagugacaacuaucaacauuaauacccucaagaaagcaggcgggguuuauaagaagacgcagcugaccccuaggggacaguugcauaacgagacaaucuacggcagccaaaaacaguauauagugaaggaagagacuauuaaugcuaaauucgacguagaaaagaucgccaccgucacaaacccaguguaccgagaggcgcuguuaaaacggcucgaacagaauaacaaugaucccaagaaggccuucacugguucaaacgcucugaccaaaaagccgaugugguuugacgagcaacagacggagaaaguuccugaaaaggugaaaacagucaguuucgagaccaucuacacuauucgcaaggaaauaucccccgaucuuaagaucgagaaagugguagacgaaaaggugagacagauucugaauaacagguugaaugaguauaacgggaaugcaaaacaggccuuuucuaaccucgaugagaauccaaucuggcugaacaaggaaaaaggcauuacaaucaagcggguuaccauaacuggaaucaacaaugcucaagcccuacacgagaagcuggacaaagauggcaagccuauucuugacggggaaggcaaaaagcagcccgucgacuucgugaacaccggaaauaaccaucacguggcagucuacugugaugcggacgguaaucuccaggagaacguuaucagcuuuuaugaggccgugacacgaagaaaucugggguugccaauuaucgauaaagacuacaagaaagaugacggauggcaguucuuauuuuccaugaagcaaaacgaauauuucguguuucccaaugagucaacgggcuucaacccuaaugaaguagaucugcucaacccagacaauuacagccugauaaguccgaaccuuuuucgcguccagaaguucaccauuaaagauuauuucuuuaggcaccaucuggagacuaauguggaaucuaacuccacauugaaggguaucaccuggcuacguugcggccugaacaauaucgacaacauuaucaaaguucggauaaaucacauugggcagaucauucaugugggagaguacuga

SEQ ID NO: 3313 - RNA, 4248 nt, Artificial Sequence
  Cas9 variant
auggccaaguucaacaaacccuacagcaucggccuggacauugggguguccucugucggauaugcuguuauaaccgaggauuacagagugccugcauuuagguucaagguacucgguaauacagaaaaagagaagaucaaaaagaaccuuauuggcucaacuacguuugugccagcccagagugcgcaagucacccggguguuccgcguuaaucgacguagaaucgacaggcggaaccaccgcauugcuuaucugagagauaucuuucagaaggaaauagagaaaguggacaagaauuucuacaggcgguuggaugagagcuuucgcgucuuaggggacaaauccgaggaucugcagaucaagcagccguucuuuggagacaaagagcuagaaacagccuaucauaagaaguaccccacuauuuaucaccuccgaaaacaucuggcagaugccgacaagaacucuccuguggcugauaucagagagguauacauggcacuuucgcacauucugaaauacaggggccauuucuugacccucgacaagaucaauccaaacaauauaaacaugcaaaauucauggauuaacuuuaucgaaagcugccaggagguuuucgaucuggaggugagugaagaguccaaaacaauugccgcuaucuuuaagucuagcgaaaaucggcaggagaaagucaagcagauccuguccuauuuccaacaggaacucuuaaagaaagacaagucaauuuucaaacagcugcuucaguugcuguuuggucuaaagaccaaauucaaggacuguuuugagcucgaggaagaacccgaucugaacuucaguaaggaaaauuacgacgagaaccuugaaaaccuguuggggacucucgaggaggauuuuagcgacguguucgccaaacugaagauauuacgugauacaauccugcucucugacaugcuuaccuauacgggagcgacucacgcacgcuuuuccgccaccaugguggaaagauacgaggaacacaggaaagaucugcaacgguucaagucauuugucaaacagaauuugagcgagcaggacuaucuagauauuuucggccgaaagacaccuaacggcuuugacguugauaaggaaacuaaaggguacgugggauauaucaguaauaagaugguacugaccaacaaacaaaagacaauacagcagaauuucuacgacuacauuucugguaaaaucaccggcaucgagggggcugaguauuuucucaacaagauuuccgacggaacguuccugcgcaagcucagaacuacagauaauggcgccaucccaaaccagauucaugcauacgaacuggagaaaauaaucgaaaggcaaggucgggacuaucccuucuugcucgagaauaaggauaaacuguuaagcauucugaccuuuaagaucccuuacuauguggggccacuagcuaaaggaaacaauucgcgcuucgccuggaucaagagagcgacuucucaggacauucucgaugacaacgaugaggacacaaggaauggcaaaauacguccguggaacuaccacaagcugaucaauauggauaagacccgggacgccuuuauuacgaaccuuaucggcaacgauauuaucuugcugaaugaaaaaguccuccccaagcgaucccugauauaugaggaagugaugcuucagaacgagcugaccagaguuaaauacaaggacaaauacgggaagacacauuucuuugauucagaauugaggcaggagaucauuaauaaccucuucaagacuaauaguaaacgcgugagcuccgcaaugcuguuaaacuaucuggagaauuacaccaaccuacaagcugucgaaaucgugucuggaauugagaaggguaaaagccucaauucaacacugaagacuuauaacgaccuuaaaaccaucuuuagugaagaguugcuggacuccgaaauauaccagaaggagcucgaggaaauuguaaagguuaucacaguguucgaugacaaaaagagcauuaaaaauuaucugaccaaguacuuuggccgguuagaguuccugaacgaagagagaaucaaucagcuuucuaaauugagguauacuggguggggacgcuacucagccaagcuccugcuagauauacgagacgaagauacgggcuuuaaccugaugcaguuccuccggaaugacgaugagaaccguaaccugagucaacuuaucagcgacuccacauugucuuuugauucggcuauuaagagcauccaguccaaaucaaccgucgaggacgauguguucgacgaaauuaagaaacuggccgguaguccugcaaucaagagagggauauuaaauucuauuaaaaucgucgaugagcucgugcagaucauuggcuacccaccccagaacaucguuauugaaauggccagggagaauaugacuaccgaggaaggacaaaagaaagcuaagacacgcaagaccaaacuggagagcgcgcuuaagaacauagaaaauuccgugcuggagaacggcaaaguaccucacucagacgaacaguugcagagcgagaagcucuaucuguacuaucuacaaaaugggaaagacauguacucucuggauaagacuggauccccaacaccccucuaucgggacagacuggaucaguacgaggucgaccacaucauuccguauaguuuccuuccuaucgauagcauugacaacaagguguugacgcauagggaaaauaaccagcgaaaacugaauaacauccccgauaaggagaccguugcaaauaugaaaccauuuugggaaaaguuauacaacgccaaacucauaucucagacuaaguaccaacgccugacaaccuccgagcggacaccugacggugugcuuacugaaucaaugaaggcuggcuucaucgagagacagcuggucgagaccaggcagauuaucaaacacguggcccguauucuagauaaucgcuuucucgacacgaagaucauaacccugaaaagucaguugauuacaaacuuccggaacacuuuucauaucgcaaagaucagagaacugaaugauuaucaccaugcccacgacgcuuacuuagccguagugauugggcaaacccuccugaaagcauaucccaaacuugcgccagagcugauauacggacaccaugcucacuucaacaggcaugaagagaauaaggccacaauccgaaagcacuuguauagcaacauuaugcgguuuuucaauaaccccaauucgaagguuuccaaagacaucuggaacugcaaucgcgaucucccuauuaucaaggacauaaucuacaacucucaggucaauuuugugaaaagaacuaugauuaagaagggcgcauucuauaaacagaacaucauuccaaaugauagcucagugaccgucgacaagagguuuccgaucaaaaacaagaaauaccuggaucccaagcuauacgguggguauuacgaacggaauagugcccuguccguuuucauaauuggccagucuuucaacaaaaauaacaaacuuaagguggugaaggaguuuuaugacaucaacaucauugauuacccucucuucaauacggacccaaugagcuuuuucaacgaugacuccgagaauggauuucugacaaagaacaauuugcaaucaguacaggcuuucuauaaaauccccaaguacagccugauacagaaaaacgauggcacccgaauguuauuugaaaguacuacaaauuuccacaaggccacccaauuuaagcucacugaggcacagaacgaacuguucuuucauaugaaaagacuucugaccaagacagacuucauggauuugaaaucugaggaguccauuaaggaaagccaggacuuuaucaugaaucacaaaaacgaguucgacaauauugucaacgggcuuuucggauaugcugaacgccagcuggguucgaagucacuauuuacgcaagcccaugaggcguacaagcugaggaaauacccuguguucucucuuaaugaagagaccauccguuauuacuaugauaacuuucuccggcuguucaguuugacuaaguccggcacaagcucuggguacguugugggauuauuugaggccccaaaacugagaaaugucguguauagggcuaccaaggacgaaagcaacgcaacacucauacaccaguccauuacuggccuguacgagacccgcaucgaucuuucaaaacugggugaagacuga

SEQ ID NO: 3314 - RNA, 4248 nt, Artificial Sequence
  Cas9 variant
augaaccugagaaauguggccaaggagggcaucaacuacaauauugggcucgaccuuggaaccgguagcgucggcugggcuguuacagaugaacagggggagcuguucuccuuuaaaggaaagacuacguggggcucuaggauauuccccaccgcagaaacagccgcggacacucgguugaaacgcggucaacgacguagauaugcuaggcggcgcuggagauuagaucugcuacagucacucuuugaggaagagaucaagaaaguggacccugaguucuuuaccaggcugcggcagagucaccuucugaaggaagauaagacauacgccgcaauuuugagcuccaaaggggccacccgcccacucuucccggagggagaagcugagguagaguauuacaagaaauaucccacuaucuaccaucugcgaaaggcacugauggaaucuaacaaucaggaggacauuagacucaucuauuuagccuuucacaacauagugaaagcuaggggcaauuuccugcaucaagauacaccuggccuuaccgccucgaacgcgaauaugggggacgcagucgaaaaguugugcucagcccuggaggauugguguagcagucagaacaucgaaugcgcuauucggaagaaucagaaauccauccaggaccuaauggagggaaagacgauugagccaucugaaagcaacgcccucaaagagacuuuugaugcaucccguucaagucgcaaggacaaagcuagcgugcuggccgguuggaucgcgauacaacccggcgaacaguucgagccuaagcaggccaaagaugcaucuaaggaaauugcuaaugccguuuuugggcuuuccgcuaacaugaagaaaguguucgucgagcuggaggaagaccagaagaucuacuugaauaacgacgagcaaguggaagccuuuuacaccguauguccagaugagggaguugcacucuucgaagcccugcagucaauguauagcgcuuacguguuaaugggcauucugaaaggugcggacgggggaaguaucucuuccugcaaggucgcagccuaugagcaguacaaagaggaucucaaacuucugaagacauuggugagagaauuugcucccaagaaguaugacgaguuuuucaggggcgauaucuuugacgccaaaaagggcuuccggacucgaaacuacgauccugcaaccgccaaaggguauacaaaguacaauagcgugcgcggagcuucguacgacgccuuuaagaaagaagucgagaagcuauucgaggguaccgcagcggaagaggauguuagauauacggacaugaugcaaagguuugaugaaggcacuuuccugcggcgccucaaaacaucugacaacggguccauuccauaccagcugcaccuugaggaaaugguggcuauaaucgagaaucagaagaccuuuuauccguuccuggaggaaaacaaagagaaguuugaaucauugguaacuuuccguauucccuacuaugugggaccucucacacagaagaaugccaggccagacaaccauggcaaugcacguuuugccuggagucaacggaaagagggucaggaaaacgcucgagucuaccccuggaauugggaggaggugaucgauagaaagcagagcgccgcaaaauucauggaaaggcugaccgggacguguaccuauauauuagaggaaccuguucugccacgcuacucccuacucuacgaggaauauugccugcuuaacgaguugaauggcgcucgguggagagacaugggaggcgauuggcacagguucgacuacgagacacgcauggauauuaucgaagaccuguuuaagaaaaagaaagggacugugaaguaugccaccgucgcggauuggcucgugcgagagaagcaccggucuugugccgaaguaaaaggaggucagggcgagacaggguucgagagcaagcugucaaguuacguuuucuucaaaggagugcuucaugucgacgaaaucgaugaggcugacauucccaugaucgaggaacugauuugguggaacacuuuguuugaagaucguuccauacucaaggagagcaucgaggacaaauauggcgauagacugaaugacgaacaaauuaaggcaaucugcaagaaaagguucaccgguugggggcgcuuaucuaagaaacugcuauguggcaucaaggcccagacagacaacggaccgugcucaauuauggaugugcuccgggagggcaauccuaacaacgacgcuagaagugccaccauggucuuuauggaaauaaucagggaugacaaauucggguuuacuaagcugauugaggaagagaauaagaaacgaaucagcuccguggaugacuucgauguuaacgaccuucccggaucuccagcagugcgccggacgguaaaucaggcgaagagaauugucgaugagaucguggguauagccggcugugcuccucagaacaucuuuauugaaguuacaagggacgaggaugggcguaauaaaggacgccggaccaagagaagguacgacgccauccaagaagcagugaaagucuugaagaaggagcagaaagaauauuucgaugcuaacguggccgaccugcucaagaauacugcacccgccgcucuggacgaugagcgauuagcgcuguacuuuaugcagaacggcaaaugcauguacugcgguaaggaccuugauauuaaucaguuggacaaauaucaaguagaucacauccucccacagucguacgugaaggacgauagcuucgagaacaaagcccugguucauuccgacgauaaucagcggaagucaaacaguaugcuacuggacgauucuauaauucgcaagaugaaacccuauugggaagcacucagaagcgcugggcugaucggcgagaagaaauucaagaaucuuaccaggguccggguguccgacaaagaauugggaggcuuuauugcccgacaaaugguggagacaucacagagcaugaagcugaccucuuuacuccuggagcaggccuacccugaaacucaggucagaccaguuaaggcuggguucuccagugaccuucgcaggcgucugaaauuggugaagugucgggagaucaacgauuaucaccacgcacaugacgccuaccucgcgugcgaagugggacaauuuauagcucugagacacaauaaacuauaugagaacccgaucggcuacagccaugccguaaaggauuucauugcaaaaagggccaaguacgcuucugaacacgguaagcccauggacacauaugggaugccuggauccucaaguuuugucaucagcucguucaugacguccggcuuugaugaggagaccggugaaauuuucaaagacgcaugggaugccucucuggcggcugugcgcauccaucaggcccucaaccgaaaggacuguuacauaagcagaaugccagaggaaacuucaggcgcauuuugggaugccacaauuuauagucccaaacagaccaagaaaaagcugucccuuccuuugaagaaagggcuggacccacagaaguacggaucuuauagccgggagcaauucgcuuacuuuuucguuuaugaagccaaaaagaucaaaaagaaggaggagacaaaagaauacguguucgcauccguccccgugcagguugcugccuuaguggcggccgauccgaaugcacucaucgaguuugcuaaggccgacgcugaagagaggggccugaaauucgcaaagauuguacgcgaaaaagucuacaaguaucagcuuaucgaggugaacgaugagagauuuuucgugacugggcugagaaccguccggaauggacuacagauugccuuuucagaacaagacaggaacauaguuagcggcaucguggaggguaauaguucuaacaauaaccuccuggacauuuacgauaaaaucacgaaucgcuaugccuuguacgcuucccgauucgggaagcuguuaaaccucagcggauauagagaaaauuuuauucaggcgucgcuggaggaccaggagcggguagugcuugcacugaucucauuguucaacgccaggaccaauaugauagaucucucugcuaucggcaguuccaagacagucgguaacaugagcaugacuuuugccaaagaaauggcaauggccgacaaucgcuucgcuuuuauugaucaaucugugaccggcaugcuggagagaaagacauaccuauga

SEQ ID NO: 3315 - RNA, 4251 nt, Artificial Sequence
  Cas9 variant
augggcagcagaaucauucccaugucccaggacauacugggggaguucggaaaggguaacucugugucacaaaccagugaaaggacagccuaccggagcacucgccgacuccgugagagauuucuucugaggcgggaacgcuugcacagagucuuaaauauccuggauuuccuaccuacgcauuaugcuucccagauugacuuuaaaaagaggcucggcaaauucaaggagaacaaagaaccaaagaucgcauacgauaauaagucuuuucuguuccuugacucguuuaacgagaugcugaaagauuucgagcaggaacagccgaauauguugauuaacgagaagggggaaaagaagcucauccccuaugacuggacccuguacuaucugcggaaaaaggcccuccgcgagaagauaucaaaagaggaauuaagcuggaucauucugaauuuuaaccaaaagcgaggauacuaucagcuuagaggcgaggaugaagaggaaaauccuaguaaauugguugaguuccacucccugacagugguagacguggucccagaugagcccaucaaggguaaacuagaaacuugguacucuauuauccucgacaacggguggguguacaggcggagcuccaagaccgagcuguaugauuggaaagacaagauaaaggaauuuauuguuacaaccgaucuuaauuacgacggaacugugaaaacagacaaggagggcaacgucaaacguucauuccgcgcgccuagugaaaccgauuggacgcugaucaagaaaaagacugaguaugagauugaacagagcucuaagaccaucggcgaguacaucuauaauacauugcucaaauacccagaacagaagauuagagggaaacugauaaggacuaucgagcggaaguauuacaaagaagaguuaaagcaaauucugcucaagcagaccgaguuucauaacgaacuuaaagacgauucccuguacuaugacugcuugcgagagcuauaccgcaauaacgaaucacaccagcuguuccucgagaagaaaaacuucgcucagcuguuuaucgaggauauaauuuucuaucaaagaccccuuaggagccagaagagucugaucucuaauuguccuuuggaauuuuacaaauucaaggacuccgugggaaacgagaagguacagcaucucaaagccaucccaaagagcaauccguuuuaucaagaguuccggauuuggcaguggaucucgaaccugucuauuuacuccaaauuagaugacucaaauuuuacaagucacuucuuugauagcaccgacgauugggagucccuguucgaaaugcuaaacggucgcaaggagauagagcagaaacagcuccugaaguuucuuuuggagaaaaagggcuucaaggggaaaucucugagcucagaaaucgaaaaguauagauggaauuacguugaggacaaaaaguaccccugcaacgaaacgaggagucucauucaaucccgucuggacaaaguggcaaaucuuccugagagcuuucugacucggcacgucgagcaggaauuguggcaucucaucuauucugugacagauaagaucgaguucgaaaaggcccuggacaccuucaguaaaaaguacaaaauugauacuccaacauuuguggacgcuuucaagaaaugucccccuuuuaagucagaguauggcagcuucuccgaaaaggcaaucaaaaaguuacugccacuaaugcgaaccggaaaauacugggaucucgacaacauagauaaggccacgaaacagagaauugagaagaucauuucuggugaguaugacaaggauaucagggaccgcguccgggaaaaagcuauaaaucugcuuucggagaccgauuuuaacagauugcagcuguggcucgcccaauacaucguuuaugacaggcacagcgaagcgacaucccuggauaagugggagacuauugacgacaucgugaccuacuuacauucauucaaacagcacagucugcgcaaucccauuguagaacaggugaucacagaaacuauacgagucgugaaggauauuuggucuaacuacgggaauggaagcaaagacuauuuuaacgagauccacguugaacuuggccgggagaugaaguugccggcagaggaacguaaaaggauucaggagaagaacucccaaaaugaagauaccaaccucagaaucaaggcccugcuaucagagaugcagaaugacccuaacguggaaaauguccgccccuacagcccagugcagcaggagauacugaaaaucuaugaagagggcguacucaacucuaauauugagaucgcugaugacauucugaagaucuccaaaacagcccaaccuaguagcucugaucuuaagcgguacaaauuguggcuggaacagaaguaucagucccccuacaccggggagauaauuccauuaaacaaacucuucacucccgaauaugagaucgaacauaucauuccucaaucaagauacuuugacgauaguuacaauaacaaaguuaucugcgagagcgcagugaauaagcugaaagacaacucgcuuggauaugaguucauuaaggguuacaauggccagauagucgaauguggguuuggcaaaaaggugaagaucuucuccauugaugaguaugaagacuuuguccagaaaaacuacgcuaauaacaggucuaaggccagccgacugaugauggcggauaucccagagaaaaugauugagcgccaguugaacgacacgcgguauaucucaaaguacauaaguaauauccucuccaacauugugagaucugaaagcaaugacgauggaguuaacuccaaaaaucugaucucagugaacgguaagauuacaaccguacuaaagaaagacugggggaugaaugauaucuggaacgaccugauacucccgagguucauucguaugaaucaaaucacugauagcgacaguuucaccacauggaacgagcgcuuucagaaguucauccccaccgucccuauugaacugucuaaaaauuuuuccgccaagcggauagaucacagacaucacgcaauggacgcucuugugaucgccugcgcuacuagggaucauguuaacuugcugaauaacuuauaugccaaaagcucggcacgauacgaccucaaucggaagcugcgcauuuucgagaagacaacguacaaagauaucaagaccggccagauuaucgaaagagagauaccaaaagccuuucuuaagcccuggcagaacuucacuacagacgcuaaagacgcgaucgagucaauuaucgugucuuauaagcaaagucugagggucauuaacaaauccaccaauuacuaucagaaguggguggaaaaggauggaaucgugaaaaaggagaaaauaaagcaggaaggcaaaaacugggcaauucggaagccucuacacaaggacacaguaagcgggcucguucagcugucuugggucaaagugccaaagggaaaagugaugacugccacccgaaagagcuuggauuccucauuugaccugaaaacgaucgcuaccaucacagauacugguauucaaaagaucuuaauaaaguaccucgagaguaaaggcaauaaccccgaaagcgccuucucuccggaggggauugaggacuuuaauaacaauauccaccuguauaacgauggaaagaaacauagaccuauuaccaagguccgccuuuacgaaaucggcuccaaauucccacugggugagaaggggaauaagaacgcaaaauauguugaagccgcuaagggcacaaauuuguuuuucgccguguacgcaaacaauaaaggagagaggucauucgaaacuauaccccucaaccuggugauugaccgucuaaagcugggccuuagugcgguaccugagaccaaugagaaaggggauaaccuccuguuucacuugagccccaaugaccuggucuacgugccauccgaagaugagauggaaaacuuaaagcucaucaaccuggagcauaucucuaaagaccagcuuaaucggauuuauaagaugguuucgagcacgucaaacagauguuucuuuaucaaguccgagauugcucugaguauagugaauaaaaucgaauacucuccuuugaacaagauggagaaaagcauugaaggaaucaugaucaaggaugucugccucaaacuacaggugaauaggauugguaaccuggagcgcuauuucuccuga

SEQ ID NO: 3316 - RNA, 4257 nt, Artificial Sequence
  Cas9 variant
augaaggugaaaaacauccugggccucgacauuggggucaccagcauaggauucgcccacguuacagagaaugaaaaggauaacaaaucccauaucaagcagcuuggugugagaauuaauccccugacuguagacgagcaaacgaacuuugaaaaaggcaggccugcuucugugaaugcagaucggaccuugaagcgcggggcccgaaagauguuaucacguuacaaagacagaaggaagaaccugaucgagauucuaaguaaaacaggauucaucaauagcgaauccauacucgcggaggauggcaagaacacuacccacucuacaugggcucugcgggccaaagcaucgcgcgagagaaucgaaaaggacgagcuugguaggguccuguuggccauuaauaagaaacggggguauaagucaagccgcaaagcuaagaacgaagaugagggacaggcaaucgacggcauggccauugcuaaacgacucuacgaggaaaaucugaccccaggccagcugguguaucagcucuuaagagaggggaagaaauacaucccggauuuuuauaggagugaccugcaagaugaacuugacaagguuuggaacuuccagaagcaguuucaucaggagauauugacugauacauucuacaaagacauucaaggaaagggucagcgggccaccuccgcgucuuuuuauggcguguacggguucaauacggcagaaaacaaaggaagccgugaggagaagcgccugcaggccuacgcuuggagauccgacgcccuaacuaaacagcucaccagggaagaggucgcauuugugaucacagaaauuaauaacaaccugaauaacucaaguggcuaucuuggugcuaucagcgaucggucuaaggagcuguucuuuaauaagaaaacuguagggcaauacuuguaugaacagcuccagcaaaacccccacacccgacugaagaaucagguuuucuaccgccaggacuauuuagaugaguuugagacaaucuggaccauucaguccagauacuauccugaacugacggacgaucucaaaagggagauacgggacguggucaucuucuaccaacgcaaacuuaaaucacagaagggacuggugagcuucugcgaauuggagaguaaggaaauuaugaucgagaaaaacggcaaggccgcggugaaaaagauaggcucuaaagucgccccaaaguccagcccccuauuucaggaguucaagauuuggcagguucugcauaauguggauaucaaaaacaagaaagacaagacuaaaagaccucucgaugacucggaaaaggaguaccuguuuaaugaacuuaacaucaaagggaaucugaaggcagcuaagguaauucaauugcucacacugaacaaaaaugagaccgaguuaaacuauacucagcuggaaggaaauaggacacagaaggcccuauacgaggcuuaucucaaaauccuggauaccgaagguuacgacgugaacaaccuuuugggcauuaagucuaauaaagacgaggucuuccuggaugaccucgaugugaacgcccuggaaauaaagacgaugaucaagcagauuuuuaaugcacuuaacaucaauaccgggauccuggacuucgaugccgaguuggacggaaaagcauuugagcaacaggcguccuaucaccucuggcaccuguuauacucauaugaagaggauggcaguaagagcgguaacgaacaucuguacaaacuacucgagaauaaguucggguuuaaaccagaacacgcacguauucuggccggcauaacacuuuccgacgauuacggaaacuugucugcuaaggccaugcggaagaucuauccccagauuaaagagaauaacuucagcacugcaugugagcugguuggcuaccgacauucaaagaauagucucaccaaagaagagaaccaggaaagaccucugaagaauaaauuagagcugcuuaagaagaacuccuugaggcaaccaguggucgaaaagauccucaaucagaugauuaaccuggugaacgagcuaaucgacaagaauagcgagaaagaugaacaggggucuauaaucgaguauuuucgcuucgacgaaauucggaucgagcuggccagagagcucaagaaaaacacagaugaaaggcgcgaccuggacgcugccauucgagagggaaaucuucggaacgaaaagaucuacaaauugcugcaagcacaguuugguauaaagaauccgacucguaacgauauuaucagauauagguuauacgaggaacucaagaauaacggcuauaaagaccuguacaccaauucauacauuccccaggagaaacuuuucgggaaagagaucgauauagaccacaucauuccucagaguaagcuguucgaugacagcuuuuccaacaaaacauugaccuauaauacuacgaacaaggauaagggaaaucaaacaggcuucgacuacaucgaaucuaaauaugguauugaugggaucgaggcguacaccgcucgcauagaaaaccucuuugagucgggcaagaaaaauaaggaagagggaguaagcaaagccaaguaucagaagcugcuaaagaaggaguccgaaauuggcgacggguucaucgagcgggaucugagagaaucacaguacaucgcuaaaaaggccaaagagcuccugcuucagauuacuaggaguguuguggcuaccucuggaagcaucacagcccgauugcgcgaagacugggaucuggucaacgugaugaaggaguuaaaccucccaaaguaucgggcacugggucuuaccgagauggaagagagaaaauacggccaaaaggucgaagugauuaaagacuggacuaagagggacgaucaccgucaucacgcuauggacgcccugacaauagcguuuacgaaacauaaucacauccaguaccuaaaccaucucaaugcccgcaaggaugagcagcacaaggagcacaaaauuaucaacgcuauugaaaauaaggagaccauccugauaacugacaaauccgggaaccggaagagaguuuucaaagcacccaugccuaauuuuaggcagacagccaagcaauauuuggaagaggugcugaucucacauaaagcuaagaacaagguagucaccaaaaauaagaacaaaauuuuaggaaaggagaaaauccaggaaacacucacuccacgaggccagcugcacgaucaaaccauuuacgguuucaauugguggagccggaucacgcuuucuaagaaggugucccgcaacgagauagagaaaauuaucgacaauaacaccaaguuuuuccugcaggaauuuauccaguugaaagggaguauugccaaggcauucagcgaugcggaacucaauaaacugauguauaagggcaagauacuaaaagagaucgaaguugccauucccugcuacacacagagaaucgacauuucuaagguguuuacugauucccaaaaaucaaacagugcuaaggagaaaaauaucaagaacauacuggaccuuaaggucaggaacauccuccagaaucggcugagcgaguucaaaggagauuucaagaaagccuuuucggacuuggacaagaacccgauuugguucaauaaagaaaagggcaucuccauuaaacgagugaucauaucugggguaaagaacguggagccucugcauuauaagaaagaucacuuaggaaaugacauucucgauggcaaggaaaacagaauccccguugacuuuaucagcaccgguaauaaccaccaugucgcaauuuaccaggaugagaaagggaaucugcaggaaaagguggugucacuuuucgacgcugucaaacugguuaacgccgaugagccagugaucgacaagacauauaaucaaggauugggcuggcaguuucucuucacuaugaagcagaacgagauguuuguguucccuaaugauaacaccgguuuugaccccaaagaaauagaucugcuagacccaaguaauaagaaacugauuucccccaaccuuuuccgcguacagucuaucagcauuguccaauacggcaacaauaucgugagggauuuuaaguuccguaaccaccucgaguccguucugaaugacgacaaaguguugcaugggauaacguuccagcagauuaagucauuaggaccucugcucaacaucgucaaggugcggaucaaucaccugggcgauauuguuagcgugggggaauacuga

SEQ ID NO: 3317 - RNA, 4260 nt, Artificial Sequence
  Cas9 variant
auggccaagccccagaacuacaccaucggccuggacauugggacaaauagcgugggauggacugucacggaugaccaaaacaauauacucagaaucaaauccaagaaagcuauuggugcaaggcuuuucgaggaaggcaagguugccgcggagcggcgcucuuuucgaaccacacguagaaggcugucacggcgcaaauggagaaucaaguuguuagaggagcuguucgaugaagagauuaguaagguggacccuaacuuuuucgcuaggagccacgaguccuggaucucuccaaaagauaagcgggaacgcuauucggccauaguauuuccgacucccgaggaagacaaaaaguuccauaaugaguacccuaccaucuaucaccuacgagauagacucaugaaagacgaucagaagcaugacauuagggagaucuacguggcaauucaccauaucaugaaguaucgggggaacuuucugcacgaugaaucaauagagacauaccguagcggaaugaguucccuuggcgguggggacgaacgcaccauucugaauacuaaaaucuuggaugaccucaacgacgccuucgcugauaaucuggcaacacagggaauuucugucaacagcgccuccgcugaccagaucaaugagaucgugaccucaggccaccugaacguugauagucaaaaggccauugcgaaacucuuacugccaacgacucuuagcucugacgauaagaaacaggacaagaaaauaaagaaguuggcaaccgaugccgcuaaaaauguggccuccgcauggcugggcuauaaggcuaacuuugccgcgauccuaaauauucaggaagucgacaaagauaagaaaaagaucuacucauucgcccuccagggggcagacgaggaggauaagguggaaacacuggagagcguacuuagucaagaccagauagaaauuguugacagaaucaucaggauucggcaugcuaucgugcugggagagauuauacccgucgguaugacuuugucugaagccaugaucgagaaauacgaucagcacgcuaaggaccucaaaaaccugaagaccgugauucgaaacuuaaaagaucgcaagaaugccgugaagcugcaggcaaucuaugaccucuacgucaacaauagacaugccgauacagcuaaagcgaugaaacuugcaggcguuaagaagaggaccgagcuguuggaaccugaggaauuuaacaaauccaucgagaagcuacuggacgauagcccagugucggccgaaauuaagaaacggauagcugagaaggacuuccucccccugcaacgcucuaauuccaacgggguaaucccuaaucagcuucaccagauugagcuggaugaaaucauuaaaaagcaaucaaaauauuacccauuuuugggagagacgaacgaacacgccagugcagacguggccagaaaggcuccgacuaaacucgaucagcuguuaacauucaggguccccuauuacgugggcccucugaucaccaaggaggagcaggaggaacaggacggucauagcuucgccuggaugauacguaagaauccaaaagaucacgaaaagaucacucccuggaacuuugacgagaaaguugaccggauggcauccgcgacacaauucauuaagcgaaugaccacgaaagauaccuaucuacucggggaagacgugcugccuucuagcucacuuaaguaccaguuguuuacaguccugaaugagcucaacaaucugagaaucaaccauaagaaacuuacuagggaggaaaaggaacaggugauugaagaucuguucaaaaaguacaaaaccguaaaggcugacaaguuuaaaaauuauuggcagaagggacacgccggcuuggauguuaaaauccaaggcauggcagacccagagaaguucaacaguacaauguccacuuacauagaucuccagaaaauuuuuggggaccagcuggaugacgcccagcgccaaaacgauuucgaaaagaucauugaguauagcaccaucuuugaggaccggaagauauuaggagaaaaacugagagcugauuucguguggcuaucugaggaccagaucaagaggcucugccgccugcgacuucaggguuggggccgguugucacugaaacuccugacacguuuaaccgacgccgaugggcagaauguccuggaaagacuuuugaacaguaaugacaacuuuaugcaaauugugaaggaucccgucaucaaagcaaagauugagcagaaaaaucagaagcuccugagggcugacuggagcgaaaacgccacugaguccauccuagaugaggcguacacgucuccgcaaaauaagaaagccauacgccaggugaugcggguugugcaugacauuguaaaggcuugugauggaaaccugccugcaaaauucgccaucgaauuugcuagaucgcaggacgaugaccccaagaggacagucgcccgagcagaucgccuccagaaaaucuaugcgcaaauuagcgacgaggugguuucccagggcgugaaggaccagcugucagguaugaagagucuuaaagaucgguacuauuuguacuucaugcaagggggcagagacgccuacaccggaaagccacugaauaucgauagguuaucugacuaugauauugaccacauaaugccucagagcuucaucaaagaugacucccucgauaaccguguccuggugacucgcgcuguaaauaaccagaagucagacaaugugcccguucuucuguacggcaaccacuuggucgccgaucucgggauuaccauccgggaaaugugggacagauggcagaaaagcggaaugauuucuaagaggaagcuggcaaaucuacugacagauccagcuacccucuccgaguaucgagccgaggguuuuaucaaccggcagcugguggaaacaagucaagugauaaaacuuacugcaacgaucuugcagagcgaguuccccgacucuaagauuaucgaagucccugccaaauacaacuccauucugcgcaagcaguuugacuuauauaaaucaagagagguuaaugauuaccaucacgcuaucgacgcguaucucaguaccauagugggcaacuaccuguaccaaguguauccaaaucuuaggcggcuguucguauacggggaauuuaagaaguucagccauggagaggaggaaucgucccaccaggccguccgaagagugaaaucuaugaacuuucuagaugaccuccugcgcggcaagcacggugaugacauuuauugcaggguuacuggggaggugaucuucagccguaaagauaucauuucaaaguugaaacaggcauacaguuuuaagcagaugcuggucacacaagaaguguucaccaagaaauccgcuuuauuugaccagacaguuuauccgucucccgcccgggauagcaagacuagauccggccucauaccuaggaaacagggaauggacaccgagaucuacggcggguauucaggaaauaaggaugccuacuucgugcuggcucagguagucaaaagcaagggucauacgcuucaaguggugggcgucccaauucgcgcacugcgagccuuggcgaacuguaguaauuacucugaacagcuccugaaaaucguuaaggcucaggugcuauuuaacaagaaaaccgggaaggccaaaaagggaauuuccgacguaagaauccugcuugauaaaauacccuaucggcagccugugcucgacggcagcgcauucuacaugcuggguucgucaacauauaaguacaauuugaagcaaaucucucugagucagcaguccaugaaauauauuuuagacuacaucgaugacccaaacuucaauaagcacgagaugacuaaaauugaucagcaaaacgagaaggaaugccuccugagcgucuaugacgagauccuugauaaaauggacaaguaccugucuuuguacgauauaaauggguuuaggaagaaacuccaugugggccgcgacaaguucauuaaacuggaaguugagaagcaggccgaagcuaucaaaaacgugcuacguggauuucacgcaaauagcgauaugaccaagcuguccgaccuuggccucucaacaagucugggguucaugcaggccagcgauggaaucaaguugucugacaacgcggucuuuauuuaucaaucccccacuggcuuauucgagagacgggugaaaguuucagaccugcucaaguga

SEQ ID NO: 3318 - RNA, 4260 nt, Artificial Sequence
  Cas9 variant
augaugaucaagaacauucugggccucgaccuugggaccaauagcauaggaugggcccugaucaaacagaacuucgagaauaaguacggugaaauuuugggcaugggguccagaaucauucccaugucucaagauguguuaggagaguuuggcaaagguaacucagucagucagacagcugcaaggacuggguaucggggaguucgccgacugcgugaaagauuccuacucaggcgggagcgccugcacagagugcuuaauguacugaacuuuuugccugaacauuacgccagccagaucgacuucgagaagagguuuggcaaauucaaguaugagacggaaccaaagcucgcguacaauaacgauggcuuuuucuuuaaaaauuccuucgacgagaugcugggggauuuuaaggaccaccaguuccaucugcucgaaaacggacggaaagugccguaugauuggaccauauacuauuuacgcaagaaagcucugucucaaaagaucgagaaggaggaacuugccuggauuuugcugaauuuuaaccagaaacgagguuacuaccagcuaagaggcgaggacuucgaagaggaaaaggauagggucuucgugcggcucaaaguugaccguguggucgauucgggggagaauaucaagggaaaaauucuguaugacguguacuuugagaacggcuggaaguaugaaaaacagaucguaaagacagaggauuggauaggucgcacuaaggaauuuauuguuaccgagucaauccuuaaaaauggggacacaaagagaaccuuuaaagcaguggacagcgaaaaggauuggauugccaucaaaacuaagacagagcaagagaucgacaagagucacaaaaccgucggagcuuacauuuaugaagcacuguugcagaaccccaagcagaaaauaaagggcaaacucgugaggacgaucgagcggaaguucuaccgagaggagcugaagaaaauuuuagaacgccagaaggaguuucauccugagcugcaauccgaugaccucuauaacgauugcaucagagaacuuuacaggaauaacgaggcccaccagauaacucugucuaaaaaggacuucgugcacuugcuacugaaugaucucauuuucuaccagcggccacugcgcagccaaaaauccucagucaguaacuguacccuugaguucagaaaguauaaggacgaaaauggcguugagcaugcucaguaccugaaaacaauccccaagagcaacccuuauuaccaggaauuuaggguguggcaguggauguucaauuugaacaucuaucguaaagaugacgauacuaauguaaccaaggaguuucucucuuccacagaagacuacgagacccuguucgaauuuuuaaacaaucggaaagagguggaccaaaaggcccugcuacgacacuucaaacucaacgagaagacgcauagauggaauuaugucgaagauaagaaauacccaugcaacgagacuaagacaaugauuucaaccaggcuggaaaaaguggagaauuaccccagcgacuuccuuacucgcgaaauggagcagaacaucuggcacauuauauauaguguuaacgauaagaucgaguacgaaaaagcguugaagucuuuugcacacaagaauaaccuggacgaaaauuccuucuuugaagccuucaaaaaguuuccuccauucaaaagcgaguaugggucguuuucugaaaaggcuauuaaaaagcuccugccgcuucugcgguugggaaaguacuggaacugggaguccaucgauagaaaaucacaggguaggaucgagaagauuauaacaggcgaguucgacgggaauaucaaagauaaggugcgcgaaaaagccauucaucucaccgcagaaaacgacuuucagggacugcaauuauggcuggcucaguauaucgucuacggccgacacagugaggccagcaugauugguaaguggaacuccgcggaugaccuagaggaguuccucaagggguuuaaacagcauucucugcggaaucccaucguggaacagguaauaacggaaacccuucguguugugaaggauaucugguugaaauauggcaauggagccaaggacuucuuuagcgagauucacaucgaacugggcagagagaugaaacaaacaaaggaugagagggucgacgcaacuaaacgcauuaccgaaaacgagaauacaaaccuccggaucaaggcucuguuagccgaaaugaugaaugacaacucaguggagaauauaagaccuuacaguccaaugcagcaggaaauucugaagaucuacgaggaugggauucuuaaauccgacaucgagauagaugacgauaucuugaagauuagcaaaacugcucagcccucuucaagugaccucaagagguauaaacuguggcuagaacaacgauacaagagcccuuauaccggacagaucauuccacugaacaaacucuucacauccgaguacgaaaucgagcauauaauuccccagucucgcuauuucgaugacucguuuagcaacaaaaucaucugugaauccgccgucaauaagcugaaagauaacuacauuggucuuggcuucaucaagcaauuugggggaaugauuguggagugcggcuucgguaaaucaguugagauauuuaaggcagaagaguaugaagacuucgugaagaaacacuacgccaauaaccggaguaagagaaauaaauugcuguuagaggagaucccggaaaagaugauugauaggcagcucaacgacacccgucacaucucuaaauacauuagcgggguacuguccaauaucguccgccaggaggauggcacugacgaaggagugaacucaaagaauauaguuccuggcaacgggaagaucacgacacagcuuaaacaagacuggggacugaaugauguguggaacgaguugauucucccccgguuugaaagaaugaaucagcugaccaacagcacugacuucaccucuuggaauaagaaccaucagaaauuucuaccaacagucccuaucgaguucuccaaggguuuuaguaaaaagaggauugaucaccgacaucacgcuauggacgcgcuggugaucgcaugugccaccaaggaucacauaaaccuccugaauaaccagagcgcuaaaucugacacuaagcgguaugaucuuaaacgcaaguugaugaaauucgagagaguaguguacucccauucaaagacaggcgaaaagauugagaaggaaguucccaagcaauuccugaaaccaugggacaauuuuacggucgaugccaagaacaaaauggagaccaucaucgugaguuucaagcagaauuuaagggugauuaacaaagcaacuaaucacuaugaaaaguggauagagaaggacgggaucaaacggaaggagcucauuaaacaggaaggaacaaacugggccauccgaaagcccaugcauaaagagaccgucagcggcaagguugaucugccugguauuaagaucccaaaagggaagauacuuacagcuacuagaaaaucgcuggacaccuccuuugaccuaaagacgaucaauucuauuaccgauacaggcauccagaaaauucucaagaacuaccuggaguucaagggaagcucagaauuggccuuuaguccggaaggcaucgaggacaugaauaaaaacauagagaaguucaaugaugggaaaccccaccaauccauuaacaaggugcgcaucuuugaacugggaucuaaauucagcgugggccagacugguaauaagaaagacaaguauguagaggcagcgaaggggaccaacuuauuuuucgcugucuacgaagauaaaaauggaaagagguccuaugagacaaucccucucaacgaggugauugaacgucagaaacaaggccuggacucaguuagcuuuaagaacaaagaggauuuccuucugugcccaaaugacuugguguacguccccagugaagaugagcucgaaaacaucuacaauauagacuuuaagaaccugacuaccgagaagacggguaauauuuauaaagugguuucuuucuccggcaaccagaucuucuuuauucggcaggauaucgccauaagcauugugaauaaggcagaguucucgacacuaaacaaaauggaaagagccaucgacgggucaaugaucaaggagaauuguauuaaacugaagaucgauaggcuuggaaacauugcuaagauauga

SEQ ID NO: 3319 - RNA, 4263 nt, Artificial Sequence
  Cas9 variant
auggccaagcccaaagacuacaccaucggccuggauauugggacaaacagcgugggaugggucguuacugacgaucagaauaacauacucagaaucaaggguaaaaaggcuauuggcgcaaggcuuuucacggaggggaaaguggccgcggaacggcgcuccuuucgaaccacacguagaaggcugucucggcgcagauggaggaucaagauguuggaggaauuauucgacgaggaaauugcuaagguagauccuucauuuuucgcccggcugcacgagaguuggaucagcccaaaagacaagcgcaaacgauauuccgcaauaguguuuccgucucccgaggaagauaagaaauuccaugagucguacccuacuaucuaucaccuaagagacaagcucaugaaggaugaccaaaaacaugauauuagggaaaucuacauugccguccaccagaugaucaaggcucggggaaauuuucugcaugacgagucaguggagaccuaucguagcggcaugaguucccuuggugggcgcucugaaagaacaauacugagcguucagaccuuggaggaacucaacgaucuguucgcagagaaugaaggaacugaggagguggaacugaacgucgccuccgcugagcagauuaaugacauccucacaggcggccacuuaaacgccgacucacaaaaagaaauuaguaaucugcuuuugccaagcucuuuucccuccuucgaugacaaggcgaaagagaaacaggugaaaaagcugaucaacaauguagcaaccaacaucucaaaggccuggcuaggguacaaagcugauuuuagcacgauucucaaucuggccaagguugacaaagaucagaagaaaauauucgcauuugcccuucagggagaagacgaggaggauaaggugcaagaacuggagaguuugcucgaacagucucagacugacaucgucgauaggcugauugagauccggcacgcuauaguguuauccgaaauugugccugucgguaugacccugagcgaggcgaugaucgacaaguaugaucagcauaaagaggaccucaucacacuuaaggccguuauucgaaacacuaaagacaagaaaaaggcagcuaagcugcaagccaucuacgauuuguacgugaaaaaucgccacgcugaccuagccaaggcaaugaaacugaccggcauuaagaaaagaucggaacuccuggauccagaggaacuuaagaaggggauaucuucccuguuggacgauucacccgaggccguagagaucaaacagaggcucgaagagaagacauuccugccuuuacagcggaguaacaacaauggagugauuccaaaccaacugcaucaggucgaacuagacgagaucaucaaaaagcagagcaaauauuacccguuccucgcugaaaagaaucccgaugaguccgaggaagcgcagaaaaaggcaccuaccaagcuggacgcccuuuugacguuucgcgugccauauuacguuggccccaugauuacuaaagaggaacaagaggcucagaacggucacucuuucgccuggauggugagaagggauccucaggaccacgaagcaauaacaccauggaauuuugagaagaaagucgauaagauggccagcgcuacccaguucaucaaacguaugacuacaaaggacaccuaucugcucggggaggaugugcugcccgccucaagucuuaaguaccaacuguuuacgguauugaacgaacucaauaaccugcggguuaauggaaagaaguuaaccuccgacgagaaagaacaggugauugagggccuguucaagaaacagaagacagucaaggcagacaaauuugugaaguauuggcaggcgaaacauaucggcgcugauauuaaggucaaagggcuaagcgacccgucuaaguucaacucaacuaugaguaccuacaucgauuuuaagaaaauauucggagaccaacucaaugaugugaaccgacagaaugacuuugaaaagaucauugaguacagcacaaucuucgaggauagaaaaauucuggaagacaaacuuagggccgauuuugcaugguuguccgaggaacagaucaagcagcugugccgccuccggcugcaagguuggggcagauuaucugacaagcugcuuacuagguugaccgaugccgacgggcagaacguucucgagcgccuguggaacucgaaugauaacuucgugcagauaguaagcgacccuaauauuaaagcuaagaucgagcaagaaaaccagaagcuacugcgagacucccagucagauaaugccgucgagaguauucucgacgaugcauauacaucuccccagaacaaaaaggcuauccggcaagugaugcguguugugcacgacauagucaaagccugugauggaaaugugccagcgaaguucgccaucgaauuugcuagaagccaggaggacgauccuaaaaggaccacugcacgcguaaaccagaugcagaagauuuacgaccaaaucuccgaugaagugguuucacagggcgucaaggagcagcugagcgguaugaaaucucuuaaggaccgguauuacuuguauuucaugcaagggggcagagaugccuacacgggagcuaaacugaauauugacagguuauccgacuaugauguggaccauaucaugccccagaguuuugugaaggaugacagccucgauaaccgaguccugguugcccgcgcagugaauaaccagaaaucugacaaggugccagcgcuucuguucggcaauaagguagucgccgauuuggggauaacagugcgggagaugugggacaaauggcagaagcucggaaugauuuccaaaagaaagcugucaaaccuacugaccgaucccgacgcucucacugaauacagggcccaagguuuuauccgucgccagcugguugagaccagucaggugaucaaacuuacagcaaccauuuugcagagcgaguucccugauucgaagaucauugaagucccagcuaaguacaauuccauagugcggaaacaauuugaccuguauaagucuagagaaguuaacgauuuccaccaugccaucgacgcauacuuaagcacuauugugggcaauuaucucuaccagguauauccgaaccugaggcgaauguuugucuacggggaguucaaaaaguuuucaaguaacgccgaggaauccgcucacgacguggcgcggcgcgugaaaucuaugaauuuccuugaugaccugcuaagaggaacacacggcgauaacaucuauugcaggagcacgggugagauugucuuuaaucggaacgacaucauauccaagcucaagcaggccuacucauucaaacagaugcugguuacccaagaaguguucacucgaaagagcgcauuguuugaucagacaguauaccccaguccugagagagacucuaaaaagcgcuccgggcugaucccaaggaaaaagggcauggaucccgaaauuuauggaggcuacgcucauaaucaggacagcuauuucguguuagccaaaaucgagaaggucaagggguacacccuccagauugugggaguuccuauccguucgcuggagauaauuaacaaagccgaagauuuuucaacagcacuucuggacaucaucaagucuaaagugauguauaaugagaagacuggucaaccaaaacggggcauuaagaacgucgaaauauuggugaauaagcuccccuacagacagccgauccuggagaaagauguuaguuauaugcuaggguccagcgcuuacaaguacaacaugaaacagauuacccugucuaggcagagcaugaaguauauccuugacuacauugaugacccuaauuucacgaaacacgagaugaccaugaucgacgaacaaaacgagcgcgaaugucuccuguccguguaugaugagauauuggaaaaggucgacaaguaccugccauuauuugauggaaauaaauuccgagagaagcuccauucagccagaaaagaguuuguaagucugagcguggacgaugaagcgucugcuaucgagaagauucuucggggccugcacgccaacuccgaaaugcccucauuggagaaucucaaaaucaagccugcacuggguuucuuucagaugaagaacgggauuacacuaaguaacgacgccguucugcuuuaucagagccccacuggccucuucgaaaggcgcgugaaagucuccgaucuguugaaguga

SEQ ID NO: 3320 - RNA, 4263 nt, Artificial Sequence
  Cas9 variant
auggccaagcccaaagacuacaccaucggccuggauauugggacaaacagcgugggaugggucguuacugacgaucagaauaacauacucagaaucaaggguaaaaaggcuauuggcgcaaggcuuuucacggaggggaaaguggccgcgaagcggcgcuccuuucgaaccacacguagaaggcugucucggcgcagauggaggaucaaguuguuagaagaacuguucgacgaagagauugcuaaaguagauccuucauuuuucgcccggcuacacgaaaguuggaucagcccaaaggacaaacgcaagcgauauuccgcaauaguguuuccgucucccgaggaggauaaaaaguuccaugaaucguacccuacuaucuaucaccucagagacaagcugaugaaagaugaccaaaagcaugauauuagggagaucuacauugccguccaccagaugaucaaagcucggggaaauuuucuucaugacgaaucaguggagaccuaucguagcggcaugaguucccugggugggcgcucugagagaacaauauugagcguucagacccucgaggagcugaacgaucuguucgcagaaaaugagggaacugaagagguggagcucaacgucgccuccgcugaacagauuaaugacaucuuaacaggcggccaccugaacgccgacucacaaaaggagauuaguaaucuuuugcugccaagcucuuuucccuccuucgaugacaaagcgaaggaaaaacaggugaagaagcuaaucaacaauguagcaaccaacaucucaaaagccuggcucggguacaaggcugauuuuagcacgauucugaaucuugccaaaguugacaaggaucagaaaaagauauucgcauuugcucugcagggagaggacgaagaggauaaggugcaagaguuggaaagucuccuggagcagucucagacugacaucgucgauagguuaauugaaauccggcacgccauagugcuguccgagauugugccugucgguaugacccucagcgaagcgaugaucgacaaauaugaucagcauaaggaggaccuuaucacacugaaagccguuauucgaaacacuaaggacaaaaagaaggcagcuaaauugcaagccaucuacgaucuauacgugaagaaucgccacgcugaccuggccaaagcaaugaagcucaccggcauuaaaaagagaucggagcugcuugauccagaggagcugaagaaagggauaucuuccuugcucgacgauucacccgaagccguagagaucaagcagaggauugaggaaaagacauuccugccuuuacagcggaguaacaacaauggagugaucccaaaccaacugcaucaggucgagcuagacgaaaucauuaagaaacagagcaaguauuacccguuccucgcugagaaaaaucccgaugaauccgaggaggcgcagaagaaggcaccuaccaaacuggacgcccuuuugacguuucgcgugccauauuacguuggccccaugauaacuaaggaggaacaagaagcucagaacggucacucuuucgccuggauggugagaagggauccucaggaccacgaggcaaucacaccauggaauuuugagaaaaaggucgauaaaauggccagcgcuacccaguucauuaagcguaugacuacaaaggacaccuaucugcucggggaagaugugcugcccgccucaagucuuaaauaccaacuguuuacgguauugaacgagcucaauaaccugcggguuaauggaaagaaauuaaccuccgacgaaaaggaacaggugaucgaaggccuguucaaaaagcagaagacagucaaagcagacaaguuugugaaauauuggcaggcgaagcauauuggcgcugauaucaaagucaaggggcuaagcgacccgucuaaguucaacucaacuaugaguaccuacauagauuuuaaaaagaucuucggagaccaacucaaugaugugaaccgacagaaugacuuugagaaaauuaucgaauacagcacaauuuucgaggauagaaagauccuggaggacaaacuuaggguugauuuugccugguuguccgaggaacagauaaagcagcugugccgccuccggcugcaagguuggggcagauuaucugacaaacugcuuacuagguugaccgaugcagacgggcagaacgugcucgaacgccuguggaacucgaaugauaacuucguacagauugucagcgacccuaauaucaaggccaagauugagcaagagaaccagaaacuacugcgagacucccagucagauaaugcuguggaaaguauccucgacgaugccuauacaucuccccagaacaagaaagcaauacggcaaguuaugcgugugguccacgacaucgugaaggcuugugauggaaauguaccagccaaauucgcgauugaguuugccagaagccaggaagacgauccuaagaggaccacugcucgcgugaaccagaugcagaagaucuacgaccaaauuuccgaugagguugucucacagggcgugaaagaacagcugagcgguaugaagucucuuaaagaccgguauuacuuguauuucaugcaagggggcagagaugcauacacgggagccaagcugaauaucgacagguuauccgacuaugauguggaccauauaaugccccagaguuuugucaaagaugacagccucgauaaccgaguucugguggcucgcgccgugaauaaccagaagucugacaagguaccagcacuucuguucggcaauaaagucguggcggauuuggggauuacaguucgggagaugugggacaaguggcagaaacucggaaugaucuccaagagaaaacugucaaaccuacugaccgaucccgacgcccucacugaguacagggcucaagguuuuauccgucgccagcugguggaaaccagucaggucauuaaacuuacagccaccaucuugcagagcgaguucccugauucgaagauuauagaagugccagcaaaauacaauuccaucguucggaagcaauuugaccuguauaaaucuagagaggugaacgauuuccaccaugcuauugacgccuacuuaagcacuaucguaggcaauuaucucuaccaggucuauccgaaccugaggcgaauguuuguguacggggaguucaagaaauuuucaaguaacgcagaagaguccgcccacgacguggcucggcgcgucaagucuaugaauuuccuugaugaccugcuaagaggaacacacggcgauaacauuuauugcaggagcacgggugaaaucguuuuuaaucggaacgacauaaucuccaagcucaaacaggcguacucauucaagcagaugcuggugacccaagagguauucacuaaaaagagcgccuuguuuaaucagacaguguaccccaguccuaaacgagaugggucuaagagauccggccugauuccacgcaaaaggggaauggaccccgaaaucuauggcggguacgcacauaaccaggauagccacuucgucuuagcuaagauugagaaggugaaaggauauacccuccagaucguuggugugccuauacguucgcuggaaauuaucaauaaggccgaggacuuuucaacagcccuucuggauaucauuaaaucuaaggucauguacaacgagaaaacuggccaaccaaagcgggggauaaagaauguggaaaucuugguuaacaaacuccccuauagacagccgauucuggagaaggacgugaguuacaugcuaggauccagcgcuuauaaauacaauaucaagcagauuacccugucuaggcagagcaugaaauacauccuugauuauauagacgauccuaacuucacgaagcaugaaaugaccaugaucgacgagcaaaaugagcgcgaaugucuccuguccgucuacgacgagauuuuggaaaagguagauaaauaucugccauuauuugacggcaacaaguuccgagagaaacuccacucagcaagaaaggaauuugugagucugagcguugaugacgaggccucugcgaucgagaaaauucuucggggucugcacgcuaauuccgaaaugcccucauuggagaaccucaagaucaagccugcccugggguucuuucagaugaaaaacggcauaacacuaaguaaugaugcagugcugcuuuaccagagccccacuggacucuucgaaaggcgcgucaagguguccgaccuguugaaauga

SEQ ID NO: 3321 - RNA, 4263 nt, Artificial Sequence
  Cas9 variant
auggccaaguucaacaaaaauuacagcaucggccuggacauugggguguccucugucggauaugcuguugugaccgaugacuacagaguacccgcauuuaaguucaaagugcucgguaacacagagaaggagaaaauaaagaagaaucuuaucggcucaacuacguuugucccugcccagagugcgcaagggaccaggguguuccggguuaaccgccgacguauugauagaaggaaucaccggaucgcuuaucugcgcgacauuuuucagaaagagaucgaaaagguggauaaaaacuucuacagaagguuggacgagagcuuucgggucuuaggagauaaguccgaggaacugcagauaaaacagccauucuuuggcgacaaggagcuagaaacagccuaucauaagaaauacccgacuaucuaucaccuccgcaagcaucuggcagaugccgacaaaaauucucccguggcugauauucgagagguauacauggcaaucucgcacauucuuaaguacagaggucauuuccugaccuuggacaggaucaacccuaauaacauaaauaugcaaaacucauggauugauuuuaucgaaagcugccaggagguuuucgaccucgagauuagugacgaauccaaaacaaucguggccaucuuuaagucuagcgauaaucggcaggagaaagucaagaagauucuguccuauuuccagcaagaacugcucaaaaaggacaaaucaauauucaagcaguuacugcagcuuuuguuugggcugaaaaccaaguucaaggauuguuuugagcuagaagaggagccagaccucaacuucaguaaagaaaauuacgaugagaaccuggaaaacuuucuuggaagccuggaggaagacuucucugauguguuugcuaaguugaaagugcuccgugacacuauccuguuauccggcaugcugacauauaccggcacgacucgcgccagauucucagcgaccauggucgagagguacgaggaacaccggaaggaucuccagcgauuuaagagcuucguuaagcaaaaucuuagugagcaggacuaucuggauauuuuugggcgcaagacacccaacggauucgacguggacaaagaaacuaaggguuacguaggcuauaucucuaauaaaaugguguugaccaacccucagaagcagaaaacaauacaacagaauuuuuacgauuacauuuccgggaagaucaccggaaucgagggcgcagaauauuuccuaaacaagauuagcgacgguacguuccugagaaaacucaggacuacagauaauggggccgucccaaaccagauccacgcuuacgagcuggagaagauuauagaccggcaaggagaagauuaucccuuucuucuggagaauaaagacaaguugcucucgauccugaccuucaaaauuccuuacuaugugggcccauuaucuaagggcaacaauucccgcuuuggguggaucaaaagaacuaucucacaggauauucuggacgauaacgacgaagauacaaggaauggaaagauacguccguggaacuaccagaagcuaaucaauauggacgagacccgggaugccuucauuacgaaccucaucgguaacgacauuauccugcuuaaugagaaaguuuugcccaagcgaagucugauauaugaagaggugaugcuccagaacgaacugaccagagucaaauacaaggacaaauacggcaagacacacuuuuucgauagcgagcuuaggcaagaaaucauuaauaaccuguuuaagacuaauaacaaacgcguguccucugcaauguugcucgacuaucuggagaauuacaccaacuuacaggcuguagagaucguuagcgggauugaaaagggaaaaucacugaauaguacacuaaagacuuauaacgaucucaaaaccaucuucuccgaggaacugcuugacagcgagauauaccagaaggaauuggaggagauugugaaggucaucacaguguuugaugacaaaaagucuauuaaaaauuaucugaucaaguacuucggccaucucgaauuucugaacgaggaacggauaaaucaguuaucaaaacugagauauaccgguugggggagguacagugccaaacuuuugcucgauauccgcgacgaggauacuggcuucaaccugaugcaauuucuacgaaaugacgaugaaaaccggaaccugagccagcucauuuccgacucuacgcugucguucgauagcgcgaucaaguccauucagucaaaaaguacagucgaggacgacguguucgaugagaucaagaaacuugccggaucuccugcaauaaagcguggcauuuugaauagcaucaaaaucguugacgaacuggugcagauuaucggguacccaccccaaaacauuguaauagagauggcuagagaaaauaugaccacugaggagggacagaagaaagccaagaccaggaagacaaaauuagaauccgcucucaagaacaucgaaaauucaguccuggaaaacgguaaagugccucauagcgaugagcagcuucaaucugaaaagcuguauuuguacuaucuccagaauggcaaagacauguacucccuggauaagaccgggaguccaacuccccuauaucgcgaccagcuggaucaguacgagguugaccacauuaucccguauagcuuucucccuauugauucuaucgacaacaaggugcugacacaccgggagaauaaccaaagaaaacuuaauaacauacccgauaaggaaacggucgccaauaugaaaccauucugggagaaguuguacaacgcaaaacugaucucccagaccaaguaccagagguuaacuacaucagaacgaaccccugacggagugcucacagagaguaugaaggccggcuuuauugaacgccagcugguagagacucggcaaaucauuaaacauguggcuagaauccuugacaauagguuccuggauaccaagauaauugcgcuaaaaagccagcucaucacgaacuuucguaacaccuuccacaucgcaaagauucgcgagcugaaugacuaucaucacgcccaugaugcuuacuuggccguugucgugggucagacacuguuaaaagcauaucccaagcucgccccagaacugauauacgggcaccacgcucauuuuaaccggcacgaggaaaauaaggccacuaucagaaaacaucuuuauucgaacauuaugagguucuuuaauaaccccgacuccaaggugucuaaagauaucugggacugcaaucgagaucugccuauuaucaaggaggucauauacaacagccagguuaauuucgugaaacggaccaugaucaagaagggcgcauuuuauaaccaaaauccagugggaaaauucaacaagcagauugcggcuaauaaccgcuacccguugaaaacaaagguaucaagucucgacacuuccaucuacggcggguauggacccaugaacucugcccugagcauuaucauaauugcagaaagauucaaugagaaaaaggguaaaaucgagaccgucaaggaauuucacgauaucuucauuaucgacuacaagaaauuuaauaacaacccuuuccaguuucuaaaugauacguccgagaacggcuuccugaagaaaaauaacauaaauagggugcuugccuuuuaugggguuccaaaguacucacucaugcagaaaaacgacggaacacggaugcuguucgaaagcaagaguaauuugcacaaggcuacccaauuuaaacugacuaagacacagaacgaguuauucuuucauaugcgaagacuccugaccaaaucuaaucuuauggaucugaaguccgagagcgccauuaaagaaucgcagaacuucaucuugaagcacaaggaggaauuugacaauauuucaaaccaacucucugcauucagucagaaaaugcugggcgacacuaccucccuacgcaaucugaucaaggguuauaacgagaggaaaauaaaggaaauugauagcucugaggaggugaucaaauacuucuaugacaauuuuaucaagauguucagcuuugucaaguccggggcucccaaaggcauuaacgauuucuuuaacaauaaguacacaguggcccguaugcggccuaaaccagacaagaaauuccuuaacgcgacgcucauccaucagucaauuaccggacuguacgaaacuagaauagauuugaguaaguuaggcgaggacuga

SEQ ID NO: 3322 - RNA, 4263 nt, Artificial Sequence
  Cas9 variant
auggccaaguucaacaaaaauuacagcaucggccuggacauugggguguccucugucggauaugcuguugugaccgaugacuacagaguacccgcauuuaaguucaaagugcucgguaacacagagaaggagaaaauaaagaagaaucuuaucggcucaacuacguuugucccugcccagagugcgcaagggaccaggguguuccggguuaaccgccgacguauugauagaaggaaucaccggaucgcuuaucugcgcgacauuuuucagaaagagaucgaaaagguggauaaaaacuucuacagaagguuggacgagagcuuucgggucuuaggagauaaguccgaggaacugcagauaaaacagccauucuuuggcgacaaggagcuagaaacagccuaucauaagaaauacccgacuaucuaucaccuccgcaagcaucuggcagaugccgacaaaaauucucccguggcugauauucgagagguauacauggcaaucucgcacauucuuaaguacagaggucauuuccugaccuuggacaggaucaacccuaauaacauaaauaugcaaaacucauggauugauuuuaucgaaagcugccaggagguuuucgaccucgagauuagugacgaauccaaaacaaucguggccaucuuuaagucuagcgauaaucggcaggagaaagucaagaagauucuguccuauuuccagcaagaacugcucaaaaaggacaaaucaauauucaagcaguuacugcagcuuuuguuugggcugaaaaccaaguucaaggauuguuuugagcuagaagaggagccagaccucaacuucaguaaagaaaauuacgaugagaaccuggaaaacuuucuuggaagccuggaggaagacuucucugauguguuugcuaaguugaaagugcuccgugacacuauccuguuauccggcaugcugacauauaccggcacgacucgcgccagauucucagcgaccauggucgagagguacgaggaacaccggaaggaucuccagcgauuuaagagcuucguuaaacaaaaucuuagugagcaggacuaucuggauauuuuugggcgcaagacacccaacggauucgacguggacaaagaaacuaaggguuacguaggcuauaucucuaauaaaaugguguugaccaacccucagaagcagaaaacaauacaacagaauuuuuacgauuacauuuccgggaagaucaccggaaucgagggcgcagaauauuuccuaaacaagauuagcgacgguacguuccugagaaaacucaggacuacagauaauggggccgucccaaaccagauccacgcuuacgagcuggagaagauuauagaccggcaaggagaagauuaucccuuucuucuggagaauaaagacaaguugcucucgauccugaccuucaaaauuccuuacuaugugggcccauuaucuaagggcaacaauucccgcuuuggguggaucaaaagaacuaucucacaggauauucuggacgauaacgacgaagauacaaggaauggaaagauacguccguggaacuaccagaagcuaaucaauauggacgagacccgggaugccuucauuacgaaccucaucgguaacgacauuauccugcuuaaugagaaaguuuugcccaagcgaagucugauauaugaagaggugaugcuccagaacgaacugaccagagucaaauacaaggacaaauacggcaagacacacuuuuucgauagcgagcuuaggcaagaaaucauuaauaaccuguuuaagacuaauaacaaacgcguguccucugcaauguugcucgacuaucuggagaauuacaccaacuuacaggcuguagagaucguuagcgggauugaaaagggaaaaucacugaauaguacacuaaagacuuauaacgaucucaaaaccaucuucuccgaggaacugcuugacagcgagauauaccagaaggaauuggaggagauugugaaggucaucacaguguuugaugacaaaaagucuauuaaaaauuaucugaucaaguacuucggccaucucgaauuucugaacgaggaacggauaaaucaguuaucaaaacugagauauaccgguugggggagguacagugccaaguuguugcucgauauccgcgacgaggauacuggcuucaaccugaugcaauuucuacgaaaugacgaugaaaaccggaaccugagccagcucauuuccgacucuacgcugucguucgauagcgcgaucaagacaauucaguccaaaucaaccgucgaggacgacguguucgaugagaucaagaaacuugccggaaguccugcaauaaagcguggcauucuuaauucuaucaaaaucguugacgaacuggugcagauuaucggguacccaccccaaaacauuguaauagagauggcuagagaaaauaugacuaccgaggagggacagaagaaagccaagacaaggaagaccaaauuagaaagcgcucucaagaacaucgaaaauuccguccuggaaaacgguaaagugccucauucagaugagcagcuucaaagcgaaaagcuguauuuguacuaucuccagaauggcaaagacauguacucucuggauaagacuggguccccaacaccccuauaucgcgaccagcuggaucaguacgagguugaccacauuaucccguauaguuuucucccuauugauagcaucgacaacaaggugcugacgcaccgggagaauaaccaaagaaaacuuaauaacauacccgauaaggaaaccgucgccaauaugaaaccauucugggagaaguuguacaacgcaaaacugaucucucagacuaaguaccagagguuaacaaccuccgaacgaacaccugacggagugcucacugagucaaugaaggccggcuuuauugaacgccagcugguagagacccggcaaaucauuaaacauguggcuagaauccuugacaauagguuccuggauacgaagauaauugcgcuaaaaagucagcucaucaccaacuuucguaacacauuccacaucgcaaagauucgcgagcugaaugacuaucaucacgcccaugaugcuuacuuggccguugucgugggucagacucuguuaaaagcauaucccaagcucgccccagaacugauauacgggcaccacgcucauuuuaaccggcacgaggaaaauaaggccaccaucagaaaacaucuuuauagcaacauuaugagguucuuuaauaaccccgacucgaagguguccaaagauaucugggacugcaaucgagaucugccuauuaucaaggaggucauauacaacucucagguuaauuucgugaaacggacaaugaucaagaagggcgcauuuuauaaccaaaauccagugggaaaauucaacaagcagauugcggcuaauaaccgcuacccguugaaaacuaagguaagcucacucgacaccaguaucuacggcggguauggacccaugaacuccgcccugucuauuaucauaauugcagaaagauucaaugagaaaaaggguaaaaucgagacggucaaggaauuucacgauaucuucauuaucgacuacaagaaauuuaauaacaacccuuuccaguuucuaaaugauacaagcgagaacggcuuccugaagaaaaauaacauaaauagggugcuugccuuuuaugggguuccaaaguacucccucaugcagaaaaacgacggaacccggaugcuguucgaaucaaagagcaauuugcacaaggcuacucaauuuaaacugacaaagacccagaacgaguuauucuuucauaugcgaagacuccugacuaaaaguaaucuuauggaucugaagucugaguccgccauuaaagaaagccagaacuucaucuugaagcacaaggaggaauuugacaauauuucgaaccaacucucagcauucucucagaaaaugcugggcgacaccacaagucuacgcaaucugaucaaggguuauaacgagaggaaaauaaaggaaauugauuccagcgaggaggugaucaaauacuucuaugacaauuuuaucaagauguucucuuuugucaagagcggggcucccaaagauauuaacgacuucuuuaacaauaaguacacgguggcccguaugcggccuaaaccagauaagaaauuccuuaacgcgacccucauccaucaguccauuacuggccuguacgaaacaagaauagacuugucaaaguuaggagaggauuga

SEQ ID NO: 3323 - RNA, 4263 nt, Artificial Sequence
  Cas9 variant
auggccaaguucaacaaaaauuacagcaucggccuggacauugggguguccucugucggauaugcuguugugaccgaugacuacagaguacccgcauuuaaguucaaagugcucgguaacacagagaaggagaaaauaaagaagaaucuuaucggcucaacuacguuugucccugcccagagugcgcaagggaccaggguguuccggguuaaccgccgacguauugauagaaggaaucaccggaucgcuuaucugcgcgacauuuuucagaaagagaucgaaaagguggauaaaaacuucuacagaagguuggacgagagcuuucgggucuuaggagauaaguccgaggaacugcagauaaaacagccauucuuuggcgacaaggagcuagaaacagccuaucauaagaaauacccgacuaucuaucaccuccgcaagcaucuggcagaugccgacaaaaauucucccguggcugauauucgagagguauacauggcaaucucgcacauucuuaaguacagaggucauuuccugaccuuggacaggaucaacccuaauaacauaaauaugcaaaacucauggauugauuuuaucgaaagcugccaggagguuuucgaccucgagauuagugacgaauccaaaacaaucguggccaucuuuaagucuagcgauaaucggcaggagaaagucaagaagauucuguccuauuuccagcaagaacugcucaaaaaggacaaaucaauauucaagcaguuacugcagcuuuuguuugggcugaaaaccaaguucaaggauuguuuugagcuagaagaggagccagaccucaacuucaguaaagaaaauuacgaugagaaccuggaaaacuuucuuggaagccuggaggaagacuucucugauguguuugcuaaguugaaagugcuccgugacacuauccuguuauccggcaugcugacauauaccggcacgacucgcgccagauucucagcgaccauggucgagagguacgaggaacaccggaaggaucuccagcgauuuaagagcuucguuaagcaaaaucuuagugagcaggacuaucuggauauuuuugggcgcaagacacccaacggauucgacguggacaaagaaacuaaggguuacguaggcuauaucucuaauaaaaugguguugaccaacccucagaagcagaaaacaauacaacagaauuuuuacgauuacauuuccgggaagaucaccggaaucgagggcgcagaauauuuccuaaacaagauuagcgacgguacguuccugagaaaacucaggacuacagauaauggggccgucccaaaccagauccacgcuuacgagcuggagaagauuauagaccggcaaggagaagauuaucccuuucuucuggagaauaaagacaaguugcucucgauccugaccuucaaaauuccuuacuaugugggcccauuaucuaagggcaacaauucccgcuuuggguggaucaaaagaacuaucucacaggauauucuggacgauaacgacgaagauacaaggaauggaaagauacguccguggaacuaccagaagcuaaucaauauggacgagacccgggaugccuucauuacgaaccucaucgguaacgacauuauccugcuuaaugagaaaguuuugcccaagcgaagucugauauaugaagaggugaugcuccagaacgaacugaccagagucaaauacaaggacaaauacggcaagacacacuuuuucgauagcgagcuuaggcaagaaaucauuaauaaccuguuuaagacuaauaacaaacgcguguccucugcaauguugcucgacuaucuggagaauuacaccaacuuacaggcuguagagaucguuagcgggauugaaaagggaaaaucacugaauaguacacuaaagacuuauaacgaucucaaaaccaucuucuccgaggaacugcuugacagcgagauauaccagaaggaauuggaggagauugugaaggucaucacaguguuugaugacaaaaagucuauuaaaaauuaucugaucaaguacuucggccaucucgaauuucugaacgaggaacggauaaaucaguuaucaaaacugagauauaccgguugggggagguacagugccaaacuuuugcucgauauccgcgacgaggauacuggcuucaaccugaugcaauuucuacgaaaugacgaugaaaaccggaaccugagccagcucauuuccgacucuacgcugucguucgauagcgcgaucaaguccauucagucaaaaaguacagucgaggacgacguguucgaugagaucaagaaacuugccggaucuccugcaauaaagcguggcauuuugaauagcaucaaaaucguugacgaacuggugcagauuaucggguacccaccccaaaacauuguaauagagauggcuagagaaaauaugaccacugaggagggacagaagaaagccaagaccaggaagacaaaauuagaauccgcucucaagaacaucgaaaauucaguccuggaaaacgguaaagugccucauagcgaugagcagcuucaaucugaaaagcuguauuuguacuaucuccagaauggcaaagacauguacucccuggauaagaccgggaguccaacuccccuauaucgcgaccagcuggaucaguacgagguugaccacauuaucccguauagcuuucucccuauugauucuaucgacaacaaggugcugacacaccgggagaauaaccaaagaaaacuuaauaacauacccgauaaggaaacggucgccaauaugaaaccauucugggagaaguuguacaacgcaaaacugaucucccagaccaaguaccagagguuaacuacaucagaacgaaccccugacggagugcucacagagaguaugaaggccggcuuuauugaacgccagcugguagagacucggcaaaucauuaaacauguggcuagaauccuugacaauagguuccuggauaccaagauaauugcgcuaaaaagccagcucaucacgaacuuucguaacaccuuccacaucgcaaagauucgcgagcugaaugacuaucaucacgcccaugaugcuuacuuggccguugucgugggucagacacuguuaaaagcauaucccaagcucgccccagaacugauauacgggcaccacgcucauuuuaaccggcacgaggaaaauaaggccacuaucagaaaacaucuuuauucgaacauuaugagguucuuuaauaaccccgacuccaaggugucuaaagauaucugggacugcaaucgagaucugccuauuaucaaggaggucauauacaacagccagguuaauuucgugaaacggaccaugaucaagaagggcgcauuuuauaaccaaaauccagugggaaaauucaacaagcagauugcggcuaauaaccgcuacccguugaaaacaaagguaucaagucucgacacuuccaucuacggcggguauggacccaugaacucugcccugagcauuaucauaauugcagaaagauucaaugagaaaaaggguaaaaucgagaccgucaaggaauuucacgauaucuucauuaucgacuacaagaaauuuaauaacaacccuuuccaguuucuaaaugauacguccgagaacggcuuccugaagaaaaauaacauaaauagggugcuugccuuuuaugggguuccaaaguacucacucaugcagaaaaacgacggaacacggaugcuguucgaaagcaagaguaauuugcacaaggcuacccaauuuaaacugacuaagacacagaacgaguuauucuuucauaugcgaagacuccugaccaaaucuaaucuuauggaucugaaguccgagagcgccauuaaagaaucgcagaacuucaucuugaagcacaaggaggaauuugacaauauuucaaaccaacucucugcauucagucagaaaaugcugggcgacacuaccucccuacgcaaucugaucaaggguuauaacgagaggaaaauaaaggaaauugauagcucugaggaggugaucaaauacuucuaugacaauuuuaucaagauguucagcuuugucaaguccggggcucccaaagauauuaacgacuucuuuaacaauaaguacacaguggcccguaugcggccuaaaccagauaagaaauuccuuaacgcgacgcucauccaucagucaauuaccggccuguacgaaacuagaauagacuugaguaaguuaggagaggauuga

SEQ ID NO: 3324 - RNA, 4263 nt, Artificial Sequence
  Cas9 variant
auggccaaguucaacaaaaauuacagcaucggccuggacauugggguguccucugucggauaugcuguugugaccgaggauuacagaguacccgcauuuaaguucaaagugcucgguaacacagaaaaggagaaaauaaagaagaaucuuaucggcucaacuacguuugucccugcccagagugcgcaagggaccaggguguuccggguuaaccgccgacguauugacagaaggaaucaccggaucgcuuaucugcgcgauauuuuucagaaagaaaucgagaagauagacaaaaacuucuacagaagguuggaugaaucauuucggguguuaggagacaaguccgaggauauccagauuaaacagccauucuuuggcaauaaggagcuggaaacagccuaucauaagaaauacccgacuaucuaucaccuacgcaagcaucucgcagacgccgauaaaaacucucccgucgcugacauucgagagguguacaugguacugucgcacauccuuaaguacagaggucauuuccugaccuuggggaaaauagauccuaauaacauuaauaugcaaaacucauggaucgacuuuauugaaagcugccaggaugcauucgaccucgagaucagugacgaguccaagacaaucgccgcuauuuuuaaaucuagcgaaaauaggcaggagaagguuaagcagauacuguccuauuuccaacaggaacugcucaaaaaggauaaaucaaucuucaagcaguuacugcagcuuuuguuuggacugaaaaccaaguucaaggacuguuuugagcuagaagaggagccagaucucaacuucaguaaagaaaauuacgacgagaaccuggaaaaccuucugggcgccuuggaggaagauuuuagcgacguguucgcgaagcucaaaauucugcgggauacuaucuuacugucuuccaugcucacauauaccggcgcaacgcacgcccguuuuucagcuacuauggucgagcgcuacgaggaacacagaaaggaccuucaaagguucaagagcuuugugaagcagaaucugagugagcaggauuauuuggacauauucgggcggaagacccccacaggauuugauguggacaaagaaacuaaggguuacgucggcuauauuucuaacaaaaugguucuaaccaauccucaaaagcagaaaacaauccagcagaacuucuacgacuacaucuccgggaagauuaccggaaucgagggcgccgaaugcuuucugaauaagauuagcgaugguacguuccuccgaaaacugcgcacuacagacaacggggcaauaccaaaucaaauccaugcuuaugagcuugagaagauuaucgaaagacagggaagggauuaccccuuccuguuggagaacaaagacaagcuccugucgaucuuaaccuuuaaaauuccuuauuacgugggcccacuggccaagggcaauaacucucgguucgcguggauaaaacgcacuacaucccaggauguacuagacgauaaugacgaagauaccagaaacgggaagaucaggccguggaauuaucacaagcucauuaacauggacgagacgcgugaugccuuuaucauuaaucugaucggaaacgacauaauccuuuugaacgagaaagugcugcccaagcggucacucauuuacgaagaggucaugcugcagaaugaacuuacccgagugaaauauaaggauaaauacgguaagauccauuucuuuaacagugagcugagacaagaaauuaucaauaacuuguucaagacaaauagcaaaaggguuuccucugcaaugcuccugagcuacuuagagaacuuuacuaaucugcaggcuguggagauagucucaggcauugaaaaggggaaaagucuaaacuccacccucaagacauauaaugaccugaaaacuaucuucagcgaggaacuuuuggacucugagauuuaccagaaggaacuggaggagaucauaaaggugaucaccguauuugaugacaaaaagucaauuaaaaacuaucucacaaaguacuucggacaccuggaauuuuuaaaugaggagaaaaucaaccagcugaguaaacuucgcuauaccggcuggggucgguacagcgggaaguugcuccugggcauuagagaugaagacacuggauucaaucuaaugcaauuucugaggaacgaugacgaaaaucgcaaccucacgcagcugaucuccgauacaacccuuucuuucgacucggccauaaaagcuauucagagcaaguccacuguugaggaugacguguucgaggaaaucaaaaacuuggccggcagcccugcaaucaagcgagggauucugaauaguaucaaaauugucgaugaguuagugcagauaaucggauauccaccccaaaacauuaucauugaaauggcccgggagaauaugaccacagaggaaggucagaagaaagcuaagacccguaagucuaaacucgagagcgcgcugaagaacaucgaagacuccguccuugagucaggcaaagugccucacagcgaugaacagcugcaaucugagaaguuguaccucuacuaucugcagaaugggaaagacauguacucccuagacaagacuggaaguccaacaccccuguauagagaucagcucgaccaguacgagguugaucauauaaucccguauagcuuucugccuauugacucuaucgauaacaaggugcuuacgcacagggaaaauaaccaacgcaaauugaauaacauucccgacaaggagaccguagcaaauaugaaaccauucugggaaaagcuguacaacgccaaauuaaucucccagacuaaguaucagcggcucacaaccucagagagaacaccugauggcguccugacugaaaguaugaaggcugguuuuauagagaggcagcuuguggagacccgacaaauuaucaaacauguugcccgcauccuggacaaucgguucagcgauacgaagauuauaacccuaaaaucgcagcucgugacaaacuuuagaaauacuuuccacaucgcaaagauuagggaacugaacgacuaccaucacgcccacgaugcuuacuuggccgucgugguagggcagacccuguuaaaagcauaucccaagcucgcgccagagcugaucuacggccaucacgcucauuuuaaccgucacgaagagaauaaggccacacuucgcaaacaccuguauuccaacauuaugcgguucuuuaauaaccccgacucuaaggugagcaaagacaucugggauuguaauagagacuugccuauaguuaaggaugucaucuacaacucacagauuaauuucgugaaaaggacuaugaucaagaagggagcauuuuauaaccaaaauccagugggcaaacucaacaagcagauugccgcuaauaaccgauacccgcugaaaaccaaggucaguucccuagacacgucuaucuaugggggauacggucccaugaauagcgcccuguccauaauuaucaucgcagaacgguucaacgagaaaaagggcaaaauugagacaguuaaggaauuucaugauaucuuuauaauugacuacgagaaguucaauaacaauccuuuucaguuccuuaacaacgugucagaagagggguuucucaaaaagaaugaucugaaccgcguguuggcuuucuauagaaucagcaaauacagucugaugcaaaagauugacggaaccaggauguuauuugagucuaaauccaaucuccacaagguaacucaguucaagcugacaaaaacccagaacgaacuuuucuuccauaugaagcggcuguugacuaaaagcaaucucauggaucugaagucggagucagccaucaaagaaucucagaacuuuauacaaacccaccagaaugaguucgacaacauugcggaucgacuaaguaauuauucccagaagaugcugggcgaaacaaagagccuucagacgcucaucaacgguuacaaugagagaccaaucaaacaaauugacaacaaugaggaaaccauccgcuauuacuaugauaacuuuauuaagauguucucuuucgucaaaagcggggcccccaaggacauaaucaacuuuuucaaugacaaauacacugugccuaggaugcguccaaagcccgaucggaagaugcuggacgcuacauugauucaucaguccaucaccggcuuauacgagacaagaaucgaucugucaaaacucggagaagacuga

SEQ ID NO: 3325 - RNA, 4263 nt, Artificial Sequence
  Cas9 variant
augagcagaaagaacuacguggacgauuaugccaucucccuggacauuggcaaugcuucugucggguggucagcauucacccccaacuacaggcucguucgggccaaaggacacgagcuuauaggugugcgccuguuugauccugcggacacagcugaaagucgacguauggccagaacuacgaggcggcgcuauagcagaaggcgguggcgcuugcgauuacuggaugcacuauucgaccaggcccucuccgagaucgauccaucuuuucuggcuagaaggaaguacucguggguacauccggacgaugaaaauaacgcagacugcugguauggcucagugcuuuucgauagcaaugagcaagacaaacgguuuuacgaaaaguaucccaccauuuaccaucugcguaaagccuugauggaggaugacagucagcacgacauccgcgagauuuaccucgcuauccaccauauggucaaguauagagggaacuuccugguggaaggaacacuggaguccucuaaugccuuuaaggaagaugagcucuuaaaacugcuuggcaggauaacucgguacgagaugagcgaaggugagcagaacuccgacaucgaacaggaugacgagaauaaguugguugcgccugcaaacgggcaacuggccgaugcucuaugugccacccgaggaucacgcaguaugagaguggacaaugcacucgaagcucugagcgccgucaacgaucuuucuagggagcagcgggcgauugugaaagccaucuucgcaggccuggagggcaauaaguuggaccucgcuaaaauuuuuguauccaaggaguucucaagcgagaacaagaaaauccuggggauauauuuuaauaagagugauuacgaagagaaaugcguucagauuguggacucuggauuacuggaugacgaagaacgcgaguuccucgacagaaugcagggucaauauaacgccaucgcucuuaagcagcuguugggcagguccacaagcgucucggauucuaaaugugccuccuacgacgcacaccgugccaacuggaaucuaauuaagcugcagcuccggaccaaagaaaacgagaaggauaucaaugaaaacuaugggauccuggugggauggaagauugacucaggccagcgaaaaagugugagaggugagagcgcuuacgaaaauaugaggaagaaagcgaacgucuuuuucaagaaaaugauagagacuuccgaucuuucugagacagacaagaaucgccugauccacgauauugaagaggacaaguuguucccaauccaacgggauagcgacaacgggguuauaccccaucagcuccaccagaaugaacugaaacaaauuaucaagaaacagggaaaguacuauccuuuucuccuggaugcauucgagaaagacggcaagcagaucaacaagauugagggccuacucaccuuuagagugccauacuucguagggccccugguggucccugaagaucuucagaaaucagacaauagugagaaccauuggauggugaggaagaaaaagggagaaaucacgccauggaauuuugacgagaugguugauaaagacgccuccggucgcaaguucauugaacgauuggugggcacugauagcuaucugcucggggagccgacccugcccaagaacucucuucuguaccaagaguaugaagucuugaaugagcucaacaacgugcggcugucaguacguacaggaaaucacuggaacgacaaaagaaggaugcgcuuaggccgggaagagaagacucugcuaugccagagacucuuuaugaaaggucagaccguuacaaagaggaccgcugaaaaucugcuucgaaaagaguacgggcgcacguaugaguugaguggccugagcgaugaauccaaguucacuucuucgcucagcacauacggaaaaaugugucggauauuuggcgagaaguacgugaacgaacacagagaccugauggagaagaucgucgaauuacagaccguguucgaggauaaagagacucugcuucaucaauugaggcagcucgaagggauuuccgaggccgacugcgcacugcuagucaauacacacuauaccggauggggucgucugucacgcaagcuccugacgaccaaagccggcgaauguaagaucagugaugacuuugcuccucggaaacauucuaucauugagauaaugagagccgaggauaggaaccuuauggaaaucauuacagacaagcaguugggguucagcgauuggaucgagcaggaaaaucugggagcagagaacggcuccucauuaauggaagugguugacgaccuccgagugagcccaaagguaaaacgggguauuauccaaucuauacgccugaucgaugacauuuccaaggcggucgggaaaagacccaguaggaucuuucuugagcuggcugaugacauucagccuagcggccggacuaucucucgaaaguccagauugcaggaucucuaccgcaaugccaaccugggaaaagaguucaagggcauagcagacgaacuaaaugccugcucagauaaggaccugcaggaugacagguuauuccuguauuacacccaacuugggaaagauauguauacaggagaggaauuggaccuggaccguuuaaguagcgcuuacgauauugaccacaucauuccacaggccgugacucagaacgauucgaucgacaaucggguucucguggcaagagcugagaacgccaggaagaccgauuccuuuacauauaugccccaaauagcggaccgcaugcgaaauuucuggcagauccugcuugauaacggucugauuucuagagucaaauuugaacggcuaaccaggcagaacgaguucagcgagcgcgaaaaggagcguuuugugcagagaucacucguagaaacucggcaaaucaugaaaaauguggccacgcugaugaggcagcgcuacggcaacagugcugcaguuauuggguugaaugccgagcugacaaaggaaaugcaucgauacuuaggauucucccacaagaacagagacaucaaugauuaucaccaugcucaggacgcccucugugucggcauagcaggucaguuugcggccaaccggggguucuuugcugauggcgaggugucugacggagcccaaaauagcuacaaccaguaucugagggauuaccuucgcggcuauagagagaaacuguccgcagaagacaggaagcaggggcgggcuuucggauuuauugugggcucaaugcguagccaggacgagcaaaaacgcgucaauccgcgaaccggugaaguuguguggagugaggaggauaaggacuacuugagaaaagugaugaacuauaggaagaugcucguaacucagaaagucggggaugacuucggagcccuguacgaugaaacccgguacgcagccacagacccuaagggcaucaaggguauccccuuugauggcgcuaaacaggacaccucucuauaugggggauucuccagcgcgaagccagccuacgcagugcugauugagucgaaaggcaagacucgccuuguuaaugugacaaugcaagaauauucacuccugggggauagaccuucugacgaugaguugaggaaaguccuggcuaagaagaaaagugaauacgccaaggccaacaucuuacuccggcacgugcccaaaaugcagcugauucgauauggaggcggucuuaugguuauaaaguccgcuggggagcugaauaacgcacagcaguuguggcucccauacgaggaauauugcuacuucgacgaucugagccaaggaaaaggcucucuagagaaggacgaccugaagaaacuucucgauagcauccuggguuccgugcaguguuuguaccccuggcauagauuuacggaagaggaauuagccgaccugcacguagcguucgauaagcucccugaggacgagaaaaagaaugucauuaccggcaucgugucagcucugcacgccgaugcaaaaacugccaaccuuaguauuguggggaugacaggaagcuggcgcaggaugaacaauaagucuggcuauaccuuuuccgacgaagaugaguucaucuuucagucaccaagugggcuguucgaaaagcgggucacaguuggagaguugaaacguaaggcuaaaaaggaagugaacagcaaauacagaacuaaugagaagaggcuaccgacccuguccggcgcaucucagcccuga

SEQ ID NO: 3326 - RNA, 4263 nt, Artificial Sequence
  Cas9 variant
auggccaagcccaaagacuacaccaucggccuggauauugggacaaacagcgugggaugggucguuacugacgaucagaauaacauacucagaaucaaggguaaaaaggcuauuggcgcaaggcuuuucgccgaggggaaaguggcggcugaacggcgcuccuuucgaacgacccguagaaggaucucucggcgcagauggaggauuaagcuguuggaggaauuauucgacgaggaaaucgccaagguagauccuucauuuuucgcacggcugcacgagaguuggauaagcccaaaagacaagcgcaaacgauauuccgccaucguguuuccgucucccgaggaagauaagaaauuccaugagucguacccuacaauuuaucaccuaagagacaagcucaugaaggaugaccaaaaacaugauaucagggaaauuuacaucgcuguccaccagaugauaaaggugcggggaaauuuucugcaugacgagucaguugagacuuaucguagcggcaugaguucccuuggugggcgcucugaaagaaccauucugagcgugcagacauuggaggaacucaacgaucuguucgcagagaaugaaggaaccgaggaggucgaacugaacguggccuccgcugagcagaucaaugacauucucacuggcgaccacuuaaacgccgauucacaaaaagaaaucaguaaucugcuuuugccaagcucuuuucccuccuucgacgauaaggcgaaagagaagcagguaaagaagcugaucaacaauguugcaacaaacauuucaaaggccuggcuaggcuacaaagcugacuuuagcaccauacucaaucuggccaagguggauaaagaccagaagaaaaucuucgcauuugcccuucaagggggagaugaagaggacaagguccaggagcuggaaaguuugcucgagcagucucagacggauauuguggacaggcugaucgaaauacggcacgcuauuguguuauccgagaucgucccuguugguaugacucugagcgaagcgaugaucgauaaguaugaccagcauaaagaggaccucauuacccuuaaggccgugauccgaaacacaaaagauaagaaaaaggcagcuaagcugcaagccauuuacgacuuguacguaaauaaccgccacgcugaucuagccaaagcaaugaagcugacuggcauaaagaagagaucggagcuccuggacccagaggaacuuaaaaaggccaucucuucccuguuggaugacucacccgaagcuggggagauuaagcagaggcucgagggaaaaaccuuccugccuuuacagcggaguaacaauaacggcgugaucccaaaucaacugcaucaggucgaacuagaugagaucauuaagaaacagagcaaguauuacccguuccucgcggaaaagaaccccgacgaguccgaagaggcacagaagaaagccccuacaaagcuggaugcucuuuugaccuuucgcgugccauauuacguuggucccaugauaacgaaggaggaacaagaggcccaggacgggcacucuuucgcauggauggugagaagggauccucaggaccacgaagccaucacuccauggaauuuugagaaaaaggucgauaaaauggcuagcgccacacaguucauuaagcguaugaccacuaaagacacauaucugcucggagaagacgugcugcccgcaucaagucuuaaguaccaacuguuuaccguauugaacgagcucaauaaccugcggguuaauggcaagaaauuaacguccgaugagaaggaacaggugaucgagggccuguucaaaaagcagaaaaccgucaaggcggacaaguuugugaaauauuggcaggcuauucauaucggggccgauauaaaggucaaaggacuaagcgacccgucuaaguucaacucaacaaugaguacuuacaucgauuuuaaaaagauuuucggugaccaacucaaugaugcaaaccgacagaaugacuuugaaaagaucauugaguacagcaccaucuucgaagauagaaaaauacuggaggacaaacuuagggccgauuuugcuugguuguccgaggaacagauuaaacagcugugccgccuccggcugcaaggcugggggagauuaucugacaagcugcuuacaagguugacugaugccgacggacagaacgugcucgagcgccuguggaacucgaaugacaacuucguucagaucgugagcgauccuaauauuaaagcaaagaucgaacaagagaaccagaaacuacugcgagacggccaguccgaugacgcuguagagucaauacucgaugacgccuauaccaguccccagaauaagaaggcgauccggcaagucaugcgugugguucacgauauugugaaagccugugacgguaacgucccagcuaaguucgcaaucgaauuugccagaucucaggaggaugacccuaaaaggacaaccgcucgcgugaaucagaugcagaagauuuacgaucaaaucagcgacgaaguagugucccaggggguuaaagagcagcugucaggcaugaaaagccuuaaggaccgguauuacuuguauuucaugcagggaggcagagaugccuacacuggggcaaaacugaacauagacagguuaucugauuaugacauugaucauaucaugccccaauccuuugucaaggacgauagucucgacaaucgagugcugguggcgcgcgccgucaacaaucagaaaagcgauaagguuccagcuuuccuuuuuggaaacaaagugguggccgaccuggguaucacgguacgggaaaugugggauaaguggcagaaguugggcaugauuucuaaaagaaagcucuccaaucugcuaacagaccccgaugcacugaccgaguacagggcucaaggguucauccgucgccagcucgucgagacuucacaggugauuaaacugaccgccacaauacuucagagugaauuuccugacagcaagaucauugagguuccagcaaaauacaacucgaucgugcggaagcaauucgacuuguauaaguccagagaagucaaugauuuucaccaugccauugacgcuuaccugucuaccaucgugggaaacuauuuauaccagguuuauccgaaucucaggcgaauguucguguacggcgaguuuaaaaaguucagcucaaacgcggaagagagugcccacgauauggcacggcgcguaaaauccaugaacuuucuggacgaucuucugagagguacucacggggacaauauauauugcaggucuacaggcgagaucgucuucaaccggaaugauauuaucagcaagcuaaaacaggcuuacuccuucaagcagaugcucgugacgcaagaaguguuuacccgaaagucagcccuguucgaccagacugucuaccccagcccugagagagauaguaaaaagcgcucuggauugauuccaaggaaaaagggcauggacacagaaaucuaugggggauacuccgguaacaaagaugccuauuuuguucuggcugaggcagugaaggaaaaaggccauaccuuacagauaguaggggugcccauucgugcccucaauacacugaagaacagcgcgaauuacucggagaaacuucuggagaucaucaaaccucaggucauguucaacaagaaaaauggaaagccaaagaagggcgugaacgacguucggauuuugauggauaauauacccuauagacaaccggugcucgaagguggggcucuguacaugcuaggcucaucuacuuauaaguacagucugaaacagaucacccuuucccaggagagcaugaaguacauucucgacuauaucgacgauccuucuuuuaacaaacacauuauggucaauaucgaccaucaggaugaaaagaaaugucuguugagcguguacgacgagauacuggauaagauggacaaguauuuaccacucuucgauaucaacggauuuaggaaaaagcugcacgacggccgcgagaaauucguuaaacuucccguggaaaaacaagccgaggucguaaaggauauucugcgaggguugcacgcaaauuccgaaaugacgaagccuucagaccucggacugaccacagcccuaggcuuuaugcaggcucccgaugguaucaaaauuagugacgacgcaguguucaucuaccagagcccaacugggcuguuugagagacggguuaaggugucugaucuucucaaauga

SEQ ID NO: 3327 - RNA, 4266 nt, Artificial Sequence
  Cas9 variant
augaccaaguucaacaaaaauuacagcaucggccuggacauugggguguccucugucggauaugccguugugacagaggauuacagaguacccgcuuuuaaguucaaagugcucgguaacacugaaaaggagaaaauaaagaagaaucuuaucggcucaacgaccuuugucagugcacagccugccaaagggacaaggguguuccggguuaaccgccgacguauugacagaaggaaucaccggaucacuuaucugcgcgauauuuuucaaaaggaaaucgagaaaguggacaagaacuucuacagaagguuggaugaaucuuuucgggucuuaggagacaaauccgaggaucugcagauaaagcagccauucuuuggcgacaaggagcuagaaaccgcguaucauaaaaaguacccgacaaucuaucaccuccgcaaacaucuggcugaugccgacaagaauagccccguggcagauauucgagagguauacauggccaucucgcacauucuuaaauacagaggucauuuccugaccuuggacaagaucaacccuaauaacauaaauaugcagaacucauggauugauuuuaucgaaagcugccaagagguuuucgaccucgagauuagugacgaauccaaaaauaucgcugauaucuuuaagucuagcgagaacaggcaggaaaaggugaaaaagauucugccauauuuccagcaggagcugcucaaaaaggacaaauccauauucaagcaauuacugcagcuuuuguuugggcugaagacuaaauucaaggauuguuuugaacuagaggaggaacccgaccucaauuucucaaaagagaacuacgaugaaaaccuggagaauuuucuuggaagucuggaagaggacuucagcgaugucuuugcaaaguugaaagugcuccgggacacaauccuguuaucuggcaugcugaccuauacgggcgccacucacgcucguuucuccgccaccaugguggagcgcuacgaagaacacagaaaggaucuccagagguuuaaguucuuuauuaaacagaaccuuucagaacaagacuaucuggauaucuucgggcggaagacacagaauggauuugacgucgacaaagagacuaaggguuacguuggcuauauaaccaacaaaaugguguugacaaauccucagaagcaaaagaccauucagcagaacuucuacgauuacaucagcgggaaaaucacgggaauugaaggcgcggaguauuuccuaaauaagaucagugacgguacuuuucugcgaaaacuccgcacaucugauaacggggcaauuccaaaucagauacaugccuacgagcuggaaaagaucauugagagacaaggaaaagacuaucccuuccuucuggaaaacaaggauaaauugcucuccauccugaccuuuaagaucccuuacuauguaggcccauuagcuaagggcagcaauucgagguucgccuggauuaaacgggcaacuucuuccgacauacuggaugacaacgaugaggacacacgcaaugggaagaucagaccguggaacuaccagaaacuaauuaauauggaugagaccagggacgcuuuuaucacgaaccucauuggaaacgauaucauacugcuuaaugaaaagguguugcccaaacguucacugaucuaugaggaagucaugcuccagaacgagcugacccgggugaaguacaaggacaaauacgguaaggcccacuucuuugacagugaacuucgacagaauauuaucaacggccuguucaaaaauaacagcaagagaguuaaugcgaaauccuugauuaaguaucucucugauaaccauaaggaccugaaugccaucgagauagugagcggggucgagaaaggaaagucauuuaacaguacauuaaaaacuuacaaugaucugaagaccauuuucuccgaggagcuacucgacagcgaaaucuaucaaaaagagcuggaagagauuaucaaggugauaacaguauuugaugacaagaaaucuaucaagaacuaccuuacuaaauucuuuggccacuuggagauucuggaugaagagaagaucaaucagcucucaaaacugagguauagugguugggggcgcuacagcgcaaaguuacugcuugacauucgggaugaagacaccggcuucaacuugcuccaguuccugagaaaugaugaggaaaacaggaaccuaacaaaacugaucuccgacaauacccucucuuuugagccuaagauaaaggauauucagucgaaaagcacuaucgaggacgacaucuucgaugaaauuaagaaacuggcuggauccccagccaucaagcgcggcauucuuaacucaauaaaaaucguugacgaguuggugcaaauuaucggguaucccccucacaauauugucaucgaaauggcucgagagaacaugacgacagaggaaggacagaagaaggccaaaacccggaagacuaaacuggagagugcauuaaagaauauagaaaacucucuccuggagaaugguaaagugccacauagcgaugaacagcuucaguccgagaagcuguacuuguacuaucuccaaaacggcaaggacauguacacccuggauaaaacagggucacccgccccgcuauaucuggaccagcucgaucaguacgaggucgaccacaucauuccuuauagcuuucugcccaucgauucuauugacaauaaggugcuuacccaucgugaaaacaaucaacagaaauugaacaauaucccagauaaggagacuguugcuaacaugaaaccuuucugggaaaagcuguacaaugcgaaguuaauaucccagacaaaauaucagagacucacgaccagugagaggacucccgacggagugcugacagaaagcaugaaggcaggcuuuauugagcgccaacuuguagagacccggcagaucaucaaacacgucgccaggauucuggacaacagauucucugauacaaagauaaucacucuaaaaucccagcucauuaccaacuuucgaaauacguuccauaucgcuaagauucgcgaacugaacgacuaccaccacgcccaugaugcauacuuggccgugguugugggucagacccuguuaaaggucuauccaaaacucgcucccgagcugaucuacgggcaccaugcccacuuuaaucggcacgaagagaacaaggcaacacuuagaaaacaucuguauucaaauauaaugagguucuuuaacaauccugacaguaaggugagcaaagauaucugggacugcaaccgugauuugccaauuaucaaggacguaauuuacaauucgcaaaucaacuucgugaaacgcacuaugauaaagaagggcgcguucuauaaucagaacccgguuggaaaauuuaauaagcagcucgcugccaacaaucgguacccccugaaaaccaaggcacuaugucuggauacauccauuuauggcggguacggaccuaugaacucugcccuuagcaucaucauuaucgcugaaagauucaaugagaaaaaggguaagauagagacugucaaagaauuucacgacauuuucaucauugauuacgagaaguuuaacaacaauccauuccaguuucucaacgacaccucagaaaauggcuuccugaaaaagaacaauaucaacaggguguugggguuuuaucgaauacccaaauacagucugaugcaaaagauugauggaacgcggauguuauucgaguccaagucuaaucuccauaaagccacacaguuuaagcugaccaaaacucagaacgagcuuuucuuucacaugaagcgccuguugacaaaaagcaaucucauggaccugaaguccaagucagcaaucaaagaaagccaaaacuucauccuaaagcauaaagaggaguucgacaauauuaguaaccagcugucugcuuuuucccagaagaugcuuggcaauaccacuagccucaaaaaccugaucaaggguuauaaugaaagaaaaauuaaggaaauagauaucagggacgagaccauuaaguacuucuaugauaacuuuaucaaaauguucucguuugugaagucaggggccccuaaagacaucaacgauuucuuugacaauaagugcacagucgcgcggaugcgaccaaaacccgauaagaaguuguuaaacgccacgcugauucaccagucuauaaccggccucuacgagacuagaaucgaccugaguaaacuuggagaagauuga

SEQ ID NO: 3328 - RNA, 4266 nt, Artificial Sequence
  Cas9 variant
augaagaaaauccugggccucgaccuugggcccaacagcauuggaugggcccuggugaaugaggcugaaaacgagaaugaaaaguccucuauaaucaaaauugguucaagagucauccacuacggcgauaacuugguuaagguggacaaaagugggaagauuagcgcauccaugaccccugaggaagauuucucuucgggaaagggcuuaucaccaaaugccgguaggacaaaacagcggagcgcgcgccgaaaccugcaacguuauaagcagagaaggaauaaccuaaucgagauacucaaagcucauagucugaucgacaauaacuuuauuuucuccgaggaagggaaugagacuacguuuaagaccuacaaaaaccgggcccuugcagccacaaaugaaaucucucuggaggauuucauuaagguauuguuuaugaucaacaagaaacgcggauauaagagcuccagaaaagcuaagggcgacgaggauggccagcucauagacgggauggcaauugccauccagcuguacgaacacaaucaaacuccgggacaguucguguauaaccugcucaaaaacgguaagaaaaauauucccgauuuuuacaggucagacuuacagaccgaguucgaucggaucuggaacuuucagaaggcuuuccaucaagaaagucugagcgacggcaucugcgagaaacuugucgggcagaaaaagaaugugacaucugccauuuuguuuaaagaauuuaagauagagucccuggagaucaaaggaaagugggaugaaaagcgcuuuuuccgauaugagcuaagaaacaaagcgguucagcaggaacucaagcugaaugagauugcagaaugucuuguggagaucaacggcgagauaucaaauagcagugguuaccugggggccauuucugacagguccaaagaauuggucuuccaaaagaucaccgugggacaguaccucuauaaacagaucgcugccaacccuaauacuagccugaagaagcaaauuuucuaccggcaggacuauuuagaugaguucaacacacugugggaaacccaggcaaaauaccacaaggagcucacggacgaacuuaaaacucagauccgugauguaauuauauuuuaucaacgcagacugaagucgcagaaaggcuugaucucuuucugcgaguuugaguccaagcagauugaaguuuucguggacggcaagaaaucaaucaagaccagggggaugcgggucaucccaaaaaguagcccccuauuucaggaguucaagauuuggcaaauacugaauaacaucgaaauuacagaucucaaaacuaaggagucccgagagcugaccgacgaugaacgccagcuucuguuugaggaauugaauaucagaccuaaaauuucuaagaaggaggcucucaaaauccugacagaaaagccagcccaguacgacuuaaacuauaaagauauagagggaaauaagaccaacgcgaaauucuacgaggccuacaacaagaucauucaucugagcggucacgacgaaaucgauuuuacggacaagacuucagacauuaaugaguaucuaaaacagaucuucagucuccugggcauaaagcccgaaauucuugauuuugacuccagcuugaaagaugaggacuucgaaaagcaacugcacuuccagcucuggcaucugcuuuacucuuuugagggggauaacacaaaaaccggagacgagaagcuguugcagaagcucaauacuaaauucggcuuuccuguggaauaugcaaaggugaucucaaacauugcucugccagaugacuacgguaguuuaagcgccaaagcuaucaggaagauacugccgcaccuaaaagauggguucuccuauggcggacggaagucucgccccgacgagccuucggccugugaauacgcaggcuauagacauagcaaggccucccucacaaaagaugagaaggaaaauaaaaccuacaaggacaaacuggagauccuuccaaagaacucauugaggaaucccauugucgagaaaauccugaaccagacgauuaauguugugaacgcuguaaucggggauuacggaaagccugacgaaauacgucucgagcuggcgcgggaauuaaagaaaagugcagaggagcgacaagacgccaccgauucuauuagcaaggcuacagccaaacacgaaaaguauagaaaagugcugcagacugaguuuggucuuaagcacaucuccaggaaugacuugauccgcuacaagcucuaucuggaacugaaaaacaauggcuucaagacccuauacucagauacauauauugcaccauacgagaucuuuagcaaaaaguucgacauugaacauauacuccccaaagccaagcuguuugaugacucuuucuccaacaagacucuugaguugaaaagugucaaucugaagaaaggggauaugaccgcuuaugacuuugugaaggaggaauacggaacagagggcuuagccaaauacgaacagcggguucaagaucucuuccugaacaagaagagaaacgaggaccuugaucaggaaaaugagagcaggaucaccgacgagaaaauuucuaagacuaaacgcgauaagcuguugaugccggaaaacaaaaucccuacggguuuuauugaccgagagcuccgggacucccaguauaucgcaaagaaggcgaaaacaaugauggaagauauaugcaaggacguggucaccacuaccgggucagugacagaucgucugagagaggacuggcagcuaaucgauauuaugcaagaacugaauuggcccaaauacgcugcccucggccugaccgaggaguucacuaacgaagagggaaauguaaucaggaagauuaaagacuggacaaagcgcaacgaucaccggcaucacgcaauggacgccaucacgauagcuuucaccaaaagaagucauauucaguaucuuaauaacuugagcgccaggucggauaaguccucuagcaucuacggcaucgaacagaaggagcuguaucgagacaaaaauaacaaguuacgcuuugcaccaccuauucccauaaaugaguuccgggcugaagccaaaaugcagcucgagaacacucugaucucaauuaaggcgcaaaauaaaguugugacaaagaacaagaauaaaaucagugggcagaagaaacuucaggaaacccugacaccaagaggacagcuacaccucgagacuauuuacgguaagaucaaccaauaucagaccgccgaaauaaaagucggcgggacgcuggauuccgaguugaucaacaagguggcuaauaagaaaaccagggaggcacuguuaaaccgucucgccgaauuuggaaaugaccccaagaaggcuuucacagucaagaacacuauugacaaaaauccuaucuaccuggauaagcaccagucuuacaagauuccagagaaagugaagaucguuuggcaagaaccgguguauaccauacgcaaaagcauuacacccgaccuuaagcuggauaaaaucaucgacccuaagauuaaagccuugcucgagucccggcugaaggaauguaacggcgaugcaaagcuagcguuuucaaaucuggccgagaacccaaucuggcuuaauaaagagaaggguauacagauuaaaagaguaacuaucaccgggauuagcaacgcugccagucuccaugacaagaaagaucugaauggcaagcccaucuuggacgaaaagggaaacaaaauaucugucgauuucgugaauacgggcaacaaucaccauguugcaauuuacaaggacgagaacgggaaucugcacgauaacguggucacauuuuucgaagcuguggagaggguaaaccagaauuuaccugugguugacaaacucuuuaagcagaaagaaggauggcaauuccuguuuaccaugaagcagaacgaguauuucgucuucccaaaugagaucacugccuuuaaccccaaugaguucgaucuucugaacccggacaauuacuauuugaucuccccuaaccucuuucgagugcagacaaugagcaaggugauguacggcaauaacacccugcgggacuauaaauuccgccaccaucuagaaacuacccugcaggauauuaaggaacuuagagacaucgucuuuaaacaauucaagucgcucucaauuuuugauaaaauaguuaaggugaggaucaaucaccuggguaagauugugaaaacaggggaguacuga

SEQ ID NO: 3329 - RNA, 4266 nt, Artificial Sequence
  Cas9 variant
augaaggacauccugggccucgaucuugggaccaacagcauuggaugggccguggucaaagaggcucagaaugacaacgaacaauccgagauaguugauguggguguaagagugaauccccugacaacugacgaaaagacgaacuucgagaaaggcaagccuaucucuaccaaugcagauaggacauugaaacggucagcccgccgaaacuuacagcguuacaagcugagaaggaaggaacuaauugagcuccugaaagagcaccagcuuaucaguacugacaccauucugacagaaaaugggaagggaaccacuuuucagacauuggagcuccgggcgaaaagcgcuaaggagaaaaucucccuggaggagcuggcccgcgucuuccucaccauaaacaagaagagaggcuauaaaucuucgaggaaggccaaaaaugaagaugagggucaauuaaucgacgggauggaaauugcaaagcggcuguacgaggaaaaccuuacgacuggacaguugucacugcagcuacucaaagagggcaagaaaagccugccagauuauuaccgcagugaccuucaguuugagcuggauaagguguggaauuuccaaaagcaguuucauucccacaucuugaccgacgaguucuaugcucagcucaaaggcaaggggcagcgagcaacaucugcccuguuuuuagcuaaauaccaaauuuauacugccgaaaacaagggaagcagagaagauaaaaagcugcaggcguaccaguggaggguugacgcacucuccaaggagcuuacccgggaacaacuggccuucgugaucacagagauaaauaacaauuugaacaacucaagugguuaccuaggcgcuauuagcgaccguucuaaagagcuguauuuuaauaacgaaaccgucggggaguaccucuggaagcagaucgccgcaaauccgcauacgucccugaaaaaccagguguucuaucgccaggauuaccuugacgaauuugagcaaauuuggaagacucagucagcuuucuaucccgaaauccugacagagagcuugaaaaaggagcucagagauguaguuaucuuuuaccagaggaagcugaaaagucagaagucuuuaguguccuucugcgaguucgaaaauaaagaaauugagauaaagaaagaggacggaaccagcacuaagaaggucaucggccugaaaguggccccuaagucgucuccacuauuucaagaguucaaaauuuggcagaaccucaauaacgugcugauccggaagaaagguuccaagaccaaaaaggcggccaagaaucagcaggcaguccuuuuugaagaagagaaaacaauaucagaauuggaucuggaggcuaagcaagcccucuucaacgagcugaaucuuaaagggaaccugaaggcugacuauuguuuggaaauucucggauacagucccaaagagugggaaaugaauuacagcguucuggagggcaaccgaacgaauaaggccuuauaugaagcauaccugaagaucaccgaucuagagggcuaugacgccaaaaaccaccucaaggugaaacugaacaaggaugagguagaacuugacgauuugaaagugccugcuuccgagaucaaggacaugguccaggcgauuuuuaaggaagcagggaucaauacagacauucugcauuucaacgccgagcucgauggaaaagacuuugaaaaucaggcuucuuaccagcuguggcacuuacuguauagcuacgagggugaugacucaaagaguggcaacgagcuuuuguauaaacuccuggaaacuaaguucggguuuaaaaaggaguacgcccaaauacuagcaaaugugucccugagcgaugacuacggaucucucucaaccaaggccaugcgcaaaauccacccauauauuaaggaaaacaaauucaguacagcuugcgagcuggccggcuacagacauagcaagcacucccuuacuaaagaggaaaaugauaacaggguuuugcgggacucucuggagguguuaaagaaaaauucgcuccgccagcccgucguggaaaagauccugaaccagaugaucaaucuuguaaacgcacuguugaagaaauauagaaccgagaauccuaacuuuaaguucgaugaaauuaggauagagcucgcgcgugagcugaaaaagaaugcugaggaacgggccaacaugacagcaaacaucaauaaagccaagaccgaacaugagaagauuaucaaaauucuaaagaacgaauuuggucugccaaauccgacucgaaacgacaucauaagauacaggcucuaugaggagcugaaagcuaauggguacaaggaucuuuauacgaacaucaaaauuccccaagaaaaguuguucacaaaggagaucgacauugaacacaucauaccuaaaagccgcguuuucgaugacuccuuuucaaauaagacccugaguuuccggaaaacuaacuuagacaagggcgagagaaccgccuuugauuacauggaaucuaaauucggagcagacaagcucgaggaguacguggcuagggucgaagaucuguauaagaauaacauuaucagcaaagccaaguaccagaaacuucugaagaaagaguccgaaauuggcgacggguuuguggagcgcgaucuacgagagacacaguauaucgcgaagaaggccaaagaaauacuccugcagaucaccccaaaugucuugucaacuagcggagguauuacagaccggcugcgugaggauugggacuuaaucaacgugaugaaggaacucaaucugcccaaauacagagcucuuggccugacggagauggaagauaggaaguaugggcaacagguugaggugauuaucgacuggaccaaacgcaacgaucaccggcaucacgcaauggacgccuugacuguagcuuucacaaagcauaaucacauacaguaccucaacuaucugaacgccaggaaaaaugagaagcauaaggaacacucuaacauuaugggaauccagcaacuagagaccaucaaagucacagauaagaauggcaacgagaaaagaguguuuaaggcaccuaugccaaauuuccgacagguuacuaaagcguuucuggaaaacauucuuaucucccacaaggccaagaauaaaguggucaccaagaacaaaaauaagguggcugguaguaacaaaguacaggaagugcucacgccccgcgggcagcugcauaaggagaccguuuacggcaaguaccaauauuacguccagaaagaggaaaagauuggaggcaaauucgacuuggagacaauaaagaaaguggccaauccgcuguaucagagcuuacucaagaagcggcuggaagagaacgggggagacccuaaaaaggcauuuacugguaaaaauucucuugcuaagaaccccaucuaccuggaugacgcccaaaccgaacaguugccagagaaagugaagcucgucuggcuggaaaauuccuucucaauuagaaaagauaucacaccugaaaacuuuaaggacgagaagcuaauugauaaaauccuggacgaaggcguuaagaggauacuuaaagagcgucuccagaguuucgggaaugaugcaaagaaagccuucagcgaccuggagaagaaccccaucugguugaacaaggaaaaaggaauuacuaucaagcgcgugaccauuucgggcguggcuaaugcggagccauuacacacgaaaaaggaucaucuggguaaagaaauccucgacaaggaggggaagcccauaccuguagauuuuauuuccacaggcucuaaccaccacgucgccguguaucgggacgaaaaaggaaaucugcaggagaagguugugagcgucuucgaggcagugguuagagcuaaccaaggccuuccaaucaucgacaaaaccuacaaucagcaucuggggugggaauuuuuguucacuaugaagcagaacgagauguuuguguucccgaaugaaucaacaggauuuaaccccaaugauauugaccuacuggauccuaaaaacaagaggauaaucaguccaaaucucuuccgaguacagaagcuggccaccggcgacuauugguuucggcaccaucuugagacuaccgucgaaacaaaauccgccacgaaggauaugaccuacaaacgcuuaucucugaaccacauuaagaauaucauuaaagugagaaucagccaucucggugacauaguguccgucggggaguacuga

SEQ ID NO: 3330 - RNA, 4275 nt, Artificial Sequence
  Cas9 variant
augaagagaauccugggccucgaccuugggaccaacagcauuggaugggcccuggugaaugaggcugaaacagaugaggaagucuccucuauaaucagguuggguguucgggugaaccccuuaacuguagacgagacgcagaauuucgaaaaaggcaagucaauuaccacaaacgcagagcgcacucugaaacgaaguaugcguagaaaucuacaaagguacaagcuccggcgcgaugcccugguggaguuucuuaaagaacugggguucaucaccgacgagacaauuuugagcgaacagggaaacagaaccacuuuugagacaugcaggcuccgggcgaaggcugccgaggaagagaucucccuggaggaacugucucgcguccucuuaaugauaaauaagaaacgaggcuauaagucgucaagaaaagugaagaaagaagaggaugguguucugaucgacgggauggagauugcaaagaaguuauacgaagaggauuugaccccuggacagcuguguagccagcuacucgaaaguggcaaaaaggugcugccagacuucuauagguccgaucuucaagaggaacuggaccggaucuggucuguccagaaacaguuucacccggauguguucugcgacgccgcuaaggaggagauuaaaggcaagaaccguagccagacgugggcaaucuuggccaauuacuuuguauggaaagaagagguugugggguggaacgaucgcgaagcuaagaaugagacuauagaaaaggaguguaaacucgucggacugaagagaaccacaaaagguuaugaguuaaagaaagaaaacuacagguggcgggcccaagcgcugacugagcagcucggccuugaagagauugcaguggugcugcaggagaucaaugggcagauuaacgccuccucaggauauuugggcgcuaucagugaccgaagcaagguccuauacuucaaucaucaaaccguuggucaguaccagauggccgaacuggacaagaacccccacgcaucucuccgcaacaugguguuuuauagacaagauuaccuggacgaguucgauaggaucugggaaaaacaggcugaguuucauaaggaacuuacagccgagcugaaaaaggagauucgggacaugauaaucuucuaucagcgcagauugaaaucccagaaggggcucauuucauuuugcgaauuugagaggcuggaaaucguaguggagaaggauggaaagaagcaaaccaaagucauaggcuguaaggugauuccucguagccacccauuauuccaggaauuuaaaguuuggcagacgcugaaugacaucaaggugcuaggccgggagaagaaacgaaacgcgcucagugccucugaguccagagcacuguaccccgaagagaaggaaauccuugcuagggaguuggccauuaaagaaaauaugaagaaagcugauguccugaagcuccuguucgagaacccucaggagcuugaccugaauuuuaaacaaaucgaugggaaccgcacuggauucagcuuguuuucggccuauucuaagaugauugaaaaguacgguuaugagccacucgacuucaaaaagcccgcagaugaaauaaucggccagcugcggacaauuuuuaccgacuuaggguggaauacuaaccuguucacaaucgaccuaaccaaagagggaaaggagcucgaaaugcagccuuacuuuagacuguggcaucuuuuguacuccuucgagggcgauaauacgucaaccgguaacgggaaacugaucgaaaagauuaugcagcucugcggcguggagaaggaauaugccguagagcuggcuagucuuagcuuucaagacgauuacggaucccugucugcgaaagcaauaaagaggauccuuccauauuugaaagagggcaaucucuacgacguugccugugaauaugcuggguaccgccacagcaagucaagucugacaaaagaggaaauugagaacaaggugcuaaagggaaaacuggaaguccucccgaaaaauucccugcgaaaccccguggucgagaaaauccuuagccagauggugaauguuauuaacacuaucauagauaccuaugguaagccugacgagauccggguggaauuggcccgugagcugaaaaagucugcaaaggaaagagaggaauuaacaaaagccauugcuaagucaacuagggagcacgaggaaauccgcaaacuccugcaggaugaguucggcaugaugaacguaagucggaaugacauuaucagauacaaacuuuacgaggaacugaaggauaacggguauaagaccuuguacagcaaucaguauauaccaaaagagaagauuuucuccaaggaaaucgacauugagcauaucauaccccaaucucgacucuucgaugacucgcugagcaacaaaacacuagaauacaaggccaucaauauugagaaaggaaacaagaccgcauaugauuucgucaaagaaaaguacggcgaggagggucugcagcaguauaucaauaggugcgaaucccucuuuaacgacaagaaagcgaagcugcgcaaacuuaagauggagcaaaaagacauuccugauggguucaucgaccgggauuugagaaauacucaguacauagcuaagaaggcccuggcaauguuaaacgaaauuuguaggcgugugguugccacgacaggcucaaucaccgaccagcuccgcgaggauuggcagcugguggacgucaugaaagaacuuaaucugccaaaguacgaggcucuaggauuuguggagacuuaugaagauaaagacggccggaagaucaaaagaauuaaggauuggaccaagaggaacgaccaccgacaucacgccauggaugcacucacaguagcuuucaccaaagacgccuuuauccaauacuucaauaacaagaaugcggcccaggauagugggaaccggaaccacacuaauauuauaggaaucaaaacacgcuauuuugacaaggguagagcucugcccccgauuccuuuggagcaguucaggaucgaagcaaaacagcaucuggagaaguuacucgugucuauuaaggccaaaaacaagguugucacggugaaugugaaccggaccaaaaagcgaaaaggcgaaaauacuaagauccaacagacacccagagggcagcugcaccuugagaccgucuacggaagccauaaacaguauguuacaaagauagagaaggugaacgcuuccuuugacgccgcaaaaaucgcgacugugucaaagcgcgccuacaggaaugcucuguugaaacgucucgaaaccuucggcaacgauccaaagaaagccuuuacggguaagaaugcacuggagaagaacccucuauaugcugacaaauaccaaaccauucggguacccgaaaagguccagacaguggaguucgagacuaucuacaccauuagaaaaccaguugaucccgcccugaauguggacaaggucguggauguuaaagugagggcaauccuugaacgccgacucaaggaguaugggggcgacccuaagaaagccuuuguaaacuucugggaaaauccaauauggcugaacaaggagaaaggaauuagcaucaagagagucucuauccggggcauuaauaacgcucaguccauacacgugaaaaaggauaagaacgggaauccgaucugggacgaaaacggaaaacaaauucccguggauuucgucaauacaggcaacaaucaucacguugcgaucuacaggaagccuguguuggacaaaaagggucagguaacuuuugaugaggacgggaaccugauguaugaguuagacgaaguggucgugccauucuuugaggccguuacccgcgcaaaucucggacugcccauuaucgauaaagacuaccguaagagugaaggcuggcaguuccuuuuuagcaugaaacagaacgaguauuucguguuuccuaaugaaaagacggguuucaacccaaaggaggucgaucuguugaaucccgacaacuacgcuaugauaucuccgaaucucuuuagagugcaaacaauguccaaaguuauguauggcaacaaugugguccgggauuacaaguucaggcaccaucuggagaccacuguaaaagacaugaaggaacuaaaagauaucgccuacaagcaguauaagacacugucauuugggaacagugugguuaaaauucgcaucaaucacauuggacagaucgugagcgucggcgaguacuga

SEQ ID NO: 3331 - RNA, 4275 nt, Artificial Sequence
  Cas9 variant
augaagagaauccugggccucgaccuugggaccaacagcauuggaugggcccuggugaaugaggcugaaacagaugaggaagucuccucuauaaucagguuggguguucgggugaaccccuuaacuguagacgagacgcagaauuucgaaaaaggcaagucaauuaccacaaacgcagagcgcacucugaaacgaaguaugcguagaaaucuacaaagguacaagcuccggcgcgaugcccugguggaguuucuuaaagaacugggguucaucaccgacgagacaauuuugagcgaacagggaaacagaaccacuuuugagacaugcaggcuccgggcgaaggcugccgaggaagagaucucccuggaggaacugucucgcguccucuuaaugauaaauaagaaacgaggcuauaagucgucaagaaaagugaagaaagaagaggaugguguucugaucgacgggauggagauugcaaagaaguuauacgaagaggauuugaccccuggacagcuguguagccagcuacucgaaaguggcaaaaaggugcugccagacuucuaucacuccgaucuucaagaggaacuggacaggaucuggucuguccagaaacaguuucauccggauguguucugcgacgccgcuaaggaggagauuaaaggcaagaaccggagccagacgugggcaaucuuggccaauuacuuuguauggaaagaagagguugugggguggaacgaucgugaagcuaagaaugagacuauagaaaaggaguguaaacucgucggacugaagcgcaccacaaaagguuaugaguuaaagaaagaaaacuacagauggagggcccaagcgcugacugagcagcucggccuugaagagauugcaguggugcugcaggagaucaaugggcagauuaacgccuccucaggauauuugggcgcuaucagugaccggagcaagguccuauacuucaaucaccaaaccguuggucaguaccagauggccgaacuggacaagaacccccaugcaucucuccgaaacaugguguuuuaucgccaagauuaccuggacgaguucgauagaaucugggaaaaacaggcugaguuucacaaggaacuuacagccgagcugaaaaaggagauuagggacaugauaaucuucuaucagcggcgcuugaaaucccagaaggggcucauuucauuuugcgaauuugagagacuggaaaucguaguggagaaggauggaaagaagcaaaccaaagucauaggcuguaaggugauuccuaggagccauccauuauuccaggaauuuaaaguuuggcagacgcugaaugacaucaaggugcuaggccgugagaagaaacggaacgcgcucagugccucugagucccgagcacuguaccccgaagagaaggaaauccuugcuagagaguuggccauuaaagaaaauaugaagaaagcugauguccugaagcuccuguucgagaacccucaggagcuugaccugaauuuuaaacaaaucgaugggaacaggacuggauucagcuuguuuucggccuauucuaagaugauugaaaaguacgguuaugagccacucgacuucaaaaagcccgcagaugaaauaaucggccagcugcgcacaauuuuuaccgacuuaggguggaauacuaaccuguucacaaucgaccuaaccaaagagggaaaggagcucgaaaugcagccuuacuuucggcuguggcaccuuuuguacuccuucgagggcgauaauacgucaaccgguaacgggaaacugaucgaaaagauuaugcagcucugcggcguggagaaggaauaugccguagagcuggcuagucuuagcuuucaagacgauuacggaucccugucugcgaaagcaauaaagagaauccuuccauauuugaaagagggcaaucucuacgacguugccugugaauaugcuggguacaggcacagcaagucaagucugacaaaagaggaaauugagaacaaggugcuaaagggaaaacuggaaguccucccgaaaaauucccugcgcaaccccguggucgagaaaauccuuagccagauggugaauguuauuaacacuaucauagauaccuaugguaagccugacgagauccgaguggaauuggcccgggagcugaaaaagucugcaaaggaacgugaggaauuaacaaaagccauugcuaagucaacuagagagcaugaggaaaucaggaaacuccugcaggaugaguucggcaugaugaacguaagucgcaaugacauuauccgguacaaacuuuacgaggaacugaaggauaacggguauaagaccuuguacagcaaucaguauauaccaaaagagaagauuuucuccaaggaaaucgacauugagcacaucauaccccaaucuagacucuucgaugacucgcugagcaacaaaacacuagaauacaaggccaucaauauugagaaaggaaacaagaccgcauaugauuucgucaaagaaaaguacggcgaggagggucugcagcaguauaucaauaggugcgaaucccucuuuaacgacaagaaagcgaagcugcgaaaacuuaagauggagcaaaaagacauuccugauggguucaucgaccgcgauuugcggaauacucaguacauagcuaagaaggcccuggcaauguuaaacgaaauuuguagaagggugguugccacgacaggcucaaucaccgaccagcuccgugaggauuggcagcugguggacgucaugaaagaacuuaaucugccaaaguacgaggcucuaggauuuguggagacuuaugaagauaaagacggccgcaagaucaaacggauuaaggauuggaccaagagaaacgaccauaggcaccacgccauggaugcacucacaguagcuuucaccaaagacgccuuuauccaauacuucaauaacaagaaugcggcccaggauagugggaaccgaaaccauacuaauauuauaggaaucaaaacacgguauuuugacaagggucgcgcucugcccccgauuccuuuggagcaguucagaaucgaagcaaaacagcaccuggagaaguuacucgugucuauuaaggccaaaaacaagguugucacggugaaugugaacaggaccaaaaagcggaaaggcgaaaauacuaagauccaacagacaccccgagggcagcugcaucuugagaccgucuacggaagccacaaacaguauguuacaaagauagagaaggugaacgcuuccuuugacgccgcaaaaaucgcgacugugucaaagagagccuaccgcaaugcucuguugaaaaggcucgaaaccuucggcaacgauccaaagaaagccuuuacggguaagaaugcacuggagaagaacccucuauaugcugacaaauaccaaaccauucguguacccgaaaagguccagacaguggaguucgagacuaucuacaccauucggaaaccaguugaucccgcccugaauguggacaaggucguggauguuaaagugagagcaauccuugaaaggcgccucaaggaguaugggggcgacccuaagaaagccuuuguaaacuucugggaaaauccaauauggcugaacaaggagaaaggaauuagcaucaagcgagucucuaucagaggcauuaauaacgcucaguccauacaugugaaaaaggauaagaacgggaauccgaucugggacgaaaacggaaaacaaauucccguggauuucgucaauacaggcaacaaucaccacguugcgaucuaccggaagccuguguuggacaaaaagggucagguaacuuuugaugaggacgggaaccugauguaugaguuagacgaaguggucgugccauucuuugaggccguuaccagggcaaaucucggacugcccauuaucgauaaagacuaccgcaagagugaaggcuggcaguuccuuuuuagcaugaaacagaacgaguauuucguguuuccuaaugaaaagacggguuucaacccaaaggaggucgaucuguugaaucccgacaacuacgcuaugauaucuccgaaucucuuucgugugcaaacaauguccaaaguuauguauggcaacaauguggucagagauuacaaguuccggcaucaccuggagaccacuguaaaagacaugaaggaacuaaaagauaucgccuacaagcaguauaagacacugucauuugggaacagugugguuaaaauuaggaucaaucauauuggacagaucgugagcgucggcgaguacuga

SEQ ID NO: 3332 - RNA, 4278 nt, Artificial Sequence
  Cas9 variant
augagaaggaacauccugggccucgaccuugggaccacaagcauuggauucgccaaggugauagaggaugaagacuaccaaaauuccgcugucgagcugaucgguguucgggugaaccccuugacuacggaugaacagaccaauuuugagaaaggccgcccuguaucugugaacgcagaccgaacauuaaagcgugggaugagaaggaaucuggaucgguaucagcuacgcagacaccaucucauugaaguccugaaagccaaccacaucauuacuguggacaccaaacuugcggaggauggaaagaauacaacccaugcuacuuacgccguuagggcacuggccgcuacagcagagaucccauuggaagccuucgcucgggugcuccuggccauaaacaagaagcgcggcuauaaaucaagucgaaaggcgaaaaaugaggacgaaggucagcugaucgaugggauggcagucgccaagagacucuacgaggagaacuuaaccccgggacagcugagcuaucuuuugcugaaagaaggcaagaaguaccuacccgacuuuuauagguccgaucucaaugcugagcuggacaaaguguggucuuuccaaaagcaguuuuacccugaaauucuuacggaggaguucaaaaagcaccuggaaggcaaagggcagcgggccacuucggcagcuuuuuggggacaguacgguuucaacaccgccgagaauaagggcucacgugaagagaaaaaguugaaggcguaucaauggcgcagcgaagccguagaucagcagcucacaaaagaggaaguugcauacgugaucacugagauuaacaaugaccugaacaagaguuccggguauuuaggagcuaucucugacagaagcaaagagcuguuuuucaacaagcagaccgucggccaauaccucuaucagcagcuuaaacaaaauccacauacaaggcugaagggucagguguuuuaccggcaggauuauuuggacgaguucgaaaccauaugggaaacgcaggccaaguuucaccccgagcuaacugcugcccugaaagaagagauucgagaugugaucauuuucuaccaacgcaagcucaaaucccagaaggggcugaucucauucugcgaguuugaaaguaaagagaucgaagucgagaagaacggacuuaagauuaaaaagagaauaggccugaggguugcaccuaaaagcucuccauuguuccaggaguuuaagaucuggcaagugcucaauaaccuggaguuccggaauaaauccucaaaggaaguauuugugcccgacaugacagccaagcagcaguuauucgaugaacugaacauuaaaggcaaucuacucgcuagcgaggcgaucaagauacugggguacaaaaccaaggacugggaagcaaacuaucacacucuugagggaaaucgcacaaacaaaaguuuguacgaugccuaucugaagauucucgagcuggaagguuacgacgaggaucuucugaaauugucuggcuccgacgauaucgacgucagcaagaucgaaaagucggcuucugagauuaaacagauggugcaugccguuuuugaagugcucgggaucaauuccaccauucuggacuucgaugcagaggccgacggaaaggcuuuugagcagcaaacggccuauagauuauggcaucugcuauacucagcagaagaugacaacaaaaaguaucuccaggaggauauauucaucuacggccacgacaauauuggucugaaaaagaaacuuugugaaagguuuggguuccguccugagcacaccaaaaucuuggucaacguggcguuuaguggcgauuacggaagccuguccucuaaggcuaugcggaaaaucuauccauucauuaaggaacucacauacgacaaagccugccgagaggcaggcuauagacacagcgccucaagucuguccaaggaggaaauagcuacuaggccguuacagaagcgccuggggcuuuugaaaaagaaugagcuccggagccccguaguugaaaagauccugaaccagauggugaacgucgugaaugcccuaauugaugacgagaacaagagaaggaaagcacgcggacugucugaugacuuccauuuugaugagauccgaauugaacucgcucgggagcugaagaagaaugccaaagaacgugcggagaugaccacaaacaucaaugccgcuaagcaacuucacgagaaaauaaucaagauuuugcagacucaguucggugucucaaacccuaguagaaaugacaucauuagguacaaacuguaugaagaguuaaagaacaauggcuacaaagaccucuauaccaacacauacaucagcccagauauacuguuuuccaagcaaauugacaucgaucauauuaucccccagaugucucuuuucgacgauucguuuagcaauaagaccgugguuuuccgcaaagacaaccaggauaaggggaauaaaacugcauacgacuauauacugggaaaguacggcgaauuggcccucgaggaauauaucucccggauuacgucacuguuugagcuagguaaaaagaacaaggaagaggggaucaauaaagcuaaguuccagaaacugcaaaagagacucauugauaucggcgacggauuuauagagaaagaucugagggaaagucaguacauugccaagaaggcgaaaaacaugcuuuaugcaaucugucgaucugugguagccacaagcggcgagaucaccgcucgcuugcgggaagacugggaucuggucaacgugaugcaggagauuaauuuaccuaaguucagagcccucgggcugacugaaaugguugagaaaaaggacggaggucagaaagagaggaucauugacuggaccaagcguaacgaucaccgccaucacgcaauggacgcucuuacaauagccuuuacccggcacucccauauccaauaccugaaucaccuaaacgcaagaaaggaugaagccucaaaauggcauccaguggucagcaagauugaggaaaaagagacugaccucguguaugaugaccugggcaauaggaagcgacgguucaaagcucccaugccgaacuuucgcgagguagugaaggaacacuuggagaauguucugaucucucacaaggcgaaaaacaaggucgugacgaaaaauaagaacaaaauuaagacagccaaaggggaaaagaucaagaccgaguuaacuccuagaggacagcuccauaaagaaacaauauacggcagguaccgguauuacgaguccaaggaggaaaaagugggucccaaguucgaugcagagaccaucgggauggucguuaauccacaguaucgaaaacugcuucuggaaagauugacaacuaacggcaaugacccuaagaaggcuuucggaggcaaaaacacccucaguaagaauccccuguacauugaugaggccaaacaggaacuacugccagagaagauccuucuccgcuggcugaacgacgauuauagcauuaggaaagacgugacgcccgagaacuugaaggacgugaagaccaucgaaaaaguacuggaugaggggauaaagaaaauuuuacucaagcgucuggucgacuuuggaaaugauccuaaaaaggccuucucugaccuugauaagaacccaaucuggcugaaugaagcuaaaggcaucacaauuaagcgggugacuauauccgguguuaaaaacgcagaggccuugcacuacaagaaagaccauuuugggaaugcgauccucaacgaaaauggaaagcugauuccgucaaguuucgugagcaccggcaacaaucaccaugucgcuaucuauagagaugccgaggguaaccuacaagagagggugguuucgcuguuugacgcagugcagcuuguaaaugccggcgaagcugucauugaucgcgaguacaacaaagggaucggauggcaguuccucuuuacaaugaagcaaaaugaaauguucguguuucccaacgagaagacuggcuucgacccuaaagagauagaucuguugaauaccgacaaccgaaaguuaaucuccccaaaucuguuuagagugcagaaaauugcaucuaagaacuacuucuuccggcaccaccucgaaacgaacgucgaggaaaggaaagagcugaaggauaucguuuauaagccccagcuugggcugaaugccauuaaagacgugguaaaggugcgcaucaaccauuugggaaaaauaauuagcgucggcgaauacuga

SEQ ID NO: 3333 - RNA, 4281 nt, Artificial Sequence
  Cas9 variant
augcccagaaagaacauccugggccucgaccuugggaccacaagcauuggauucgccaaaauaaucgaggaugacgauuaccagugcuccucuguggaacugauuggugucaggguuaauccuuugacuacggacgagcaaaccaacuuugaaaagggcaaaccagugucaguaaaugcugaucggacauuaaagcgcgggaugcgacguaaccuggacagauaucagcuaaggcgggauuaccucaucgagauucugcgcacucaccauaucauaaccgcagacacaaaacuugccgaagauggaaagaauaccacucacacaaccuaugcgcugagagcuuuggccgcaacggccgagaucccgcucgaggcuuucgugaggguccugcuggcaauuaacaagaaacggggcuacaagaguagccgcaaagccaagaaugaagacgagggucagcucaucgaugggauggcuauugcccgaagauuauaugaagagucccugacucccggacaguuuucuuaccaacuuuugaaagagggcaagaaguaucugccugacuucuacaggucggaucuaaacaccgaacucaauaaaguguggaacuuucagaagcaguucuacccagagauccugacagacgaauuuaaacggcaucuugagggcaaggggcagcgugcgacugcaguugccuucuggggacaacacgguuuuucaauggcugaaaauaaaggcagccgcgaggagaagaaacugcaugccuauaaguggagaagugaagcagcucacaagcaguugaccaaagaggaaguggccuucgucauaacagagauuaacaaugaccucaacaaguccucuggguaccugggagcgaucagcgauagguccaaagaauuauuuuucaauaagcagaccgugggccaguaucugcaccaacagcucaaagagaacccccauacgcggcuuaagggucagguauuuuaccgacaagacuaucuggaugaguucgaaacuauuugggagaugcaggccaaguucuacucagcauugacacuagaacugaaagaggaaguucgcgacguggucaucuuuuaucagagaaagcucaaaagucagauggggcugaucagccuuugugaguucgagucuaaggaaauugagauagagaaaaacggagaaaaggcuaagaaaaggaucggccugcggguggccccuaaguccucaccauuguuucaagaguucaaaauuuggcaagugcucaauaaccuggaauuucgcaauaagaaaaccaaggaggucuucguucccgaaauggcugccaagcagcaguuauuugaugagcugaacaucaaaggcaaucuacucgcaagcgaagccauaaagauucugggguacaaaacuaaggacugggaggcuaacuaccacacacuugagggaaauagaaccaacaaaaguuuguaugaugcguggcugaagauccucgaacuggaggguuacgacgaaaaucuucugaaauugucuggcuccgaugacaucgaugugagcaagauugagaagccugcacucgaaaucaggcaaaugguacuggccguguucgaggucuuagggauuucgggagcuauacuggacuuugacgccgaggcagauggcaaagccuucgaacagcagccagcuuaucagcuauggcaucuccuguacucugccgaggacgaugguaagaaauauucccaagaagacaucuuuacguacgggcacgauaacauuggccuuaagaaaaaguugugcgagaaguucggauuucguccggaacacaccaaaauccuggugaauguuguguucucagacgauuauggcaaccucaguagcaaggcaaugcggcgaaucuaccccuucauuaaagagcugacauacgacaaggcgugugcugaggccggguauagacauuccgcagccucuuuaacuaaagaagagauagcugccaggccucugcagaaucgccuugauuugcucaagaagaacgaacugcggagcccagucguggagaaaauccuaaaucagaugguaaacguugugaacacccuggucgacgaugagaaucagaacagaaaggcaaggggacucucagaagacuuucacuucgaugagauucgcaucgaacuggcucgagagcuuaaaaagaaugccaaagaacgggcggagaugacaacuaacauuaauaccgccaagcaaagucaugagaagaucauacguaucuugcagacagaauuuggugugcccaacccuuccagaaaugacauugucagguacaaacuguaugaggaauuaaagaacaauggcuacaaagaccucuauaccaacacuuacaucagccgcgauauucuguucucuaagcagaucgacguggaucacauaauuccacaaaugucacuuuuugacgauaguuucagcaauaaaacgguuguguuucggaaggacaaccaggauaaagggaauaagacagcuuaugacuacauccugggaaaguacggcgagcaggcauuggaagaguauauuuccagaaucaccucucucuucgagcuggguaaaaagaacaaagaagaggggauaggcaaggccaaauuucagaagcuacaaaagaggcugguagauaucggagacggcuucauugaacgagaucuccgcgagucgcaguacaucgcuaaaaaggccaauaacaugcuguaugcaauuugccggagcgucguguccacuucaggggaaaucaccgcgagacuuagggaggacugggauuugguuaacgugaugcaggagauaaaucugcccaaauuucgugccuuaggacucacagaaauggucgagaagaaagacggugcucagaaggaacgcauuaccgacuggacuaagcggaacgaucauagacaccacgccauggacgcacuggcuaucgccuucacaaggcauagucacauccaauaccuuaaucaucugaacgcacgaaaagaugaggccaauaaguggcacccggugguaucuaaaauugaggaaaaggagacggugcuaaucuaugacgaucucggcaaccggaaacgcaaguuuaaggcuccuaugcccaauuucagagaaguugucaaagagcaccuggaaaacguguugauuagccauaaggcgaaaaauaagguggucaccaaaaacaagaauaagauaaaaacuguuaggggagagaaggugaaaacagagcugaccccacggggacaguuacacaaggaaacaaucuacggccgauauagauacuacgaguccaaagaagagaagauugguccuaaauucgacgccgaaaugaucgggauggugacuaacccccaguauaagaagcuccugcuugagcgccuggcagcuaauggcaacgaucccaaaaaggccuuuugggggaaaaaugccuugaacaagaacccacucuacguagacgaggcuaggcaggaacugcuaccugagaaaauucugcuucguuggcucaaugaugacuauucaauccggaaggaugucaccccagaaaaccugaaggacauaaaaacgaucgagaagauuuuggacaaaggcgugaagaaaauccuguuaaagagacucgcagauuucgggaaugacccgaagaaagccuuuagcgaucuggacaagaaccccauuuggcaaaaugaagcgaaaaggaucgcuauaaagcgcguuaccauuucuggaaucaaaaacgccgcaccucuucaucacaagaaggaucaucugggcaaugacaucuuggaugagaaagguaagcagauuccauccaguuucgugagcacagggaacaaucaccacgucgccauauaccgagacgcugagggaaaccuccaggaaagagugguuucucuguuugaugcagugcagcuaguaaauggcggugagcccgucaucgacaaagaauauaacaagggcauuggguggcaguuccuguuuacuaugaaacagaaugagauguucguguuuccugaugagaagaccggauucaacccacgggaaguggaccuucucuccucaggcaauaggaaacugaucagucccaacuuguuucgcguccagaaguuagccagcaagaauuacuucuuccgucaucaccuggagacaucgguugaagagaaaaaggaacucaaaaacauugcguauaagccgcaacuggggcuuaacgcucuguccaauaucgugaaaguaagaauaaaccauaucggagagauugugucugucggcgaguacuga

SEQ ID NO: 3334 - RNA, 4281 nt, Artificial Sequence
  Cas9 variant
augaagaacauccugggccucgaccuugggauuaccagcauauccuucgcccacaucguggaggaugaaaauaaagagaagucugaaauuaaagagcugggagucagaaucguuucauugacaacugacgaacagagugauuuugagaaggguaaaagcauuacgaccaacgcuaauaggacauuaaagcauggcgcacggcugaaccuagaccgcuaccaacagcgacguaaguaucucaucgaucugcuucagaaagccaaucugauaacuuccucuucgaucuuggcggagaacgggaagaauaccacacacucaaccuggcagcucagagcuaaagccgugacugaaaggauugagaaggaagaguucgcacggguacugcuggccaucaacaaaaagcgcggauacaagagcaguagaaaagcuaagacagaggacgaaggccaagcaauugaugguauggccaucgcuaaaaggcucuaugacgagaauuuaacccccgggcagcugucccuucaguugcugcagcaaaacaagaaacuacucccugauuuuuaccggucugaccugcagcgcgaguucgaucuuguguggaauuuucagaagcaguucuauccagacauacugacggauagcuuuuacaaagaguugcaaggaaagggcaaggacgccacuuccaaagcguucucaaagcgauaucauuuugacaccgcagaaaacaaaggcaguaaggagagcgucagacuccaggccuaccaguggagggcugaggccauuucuaaacaacuguccaaggaagagguggcauacguuuuaacagaaaucaauaacaaucugaacaacgcuucaggguaucucggagccauuagcgaucggaguaaggagcuuuacuucaaucgucagacugugggucaguaucuguacgcgcaguugcaagaaaaccgccacaauucucugaaaaacaaggucuuuuauagacaggacuaccuggaugaguucgagaggaucugggaaacccaggccuccuuucauaaagagcucacagacgaacugaagaaacagauccgggaugugguaauuuucuaucaacgaaaacuuaagagccagaaaggccugauaucguucugcgaguuugaaucuaaggagaucgagauugaaaaagacgggaagaccaucacgaaaacuauaggagcacgcguugugccgaaguccucacccuuguuccaggaguuuaagauuuggcagauccucaauaacgucacauguaaaagaaagggcaucaggaaaaagaaaaguagcgcuaaguccaccgaacuggauuuauucaaugagccuucucaaacuauuuuuagccuggacauggagugcaaacagcuacucuucgaugaacugaaccuuaagggugacuugaagucagauaaagugcugaagcuccugggguacaguccacaggagugggaaaucaauuacaaccagcuugagggaaaucggacacaaaaagcccuguaugaagcauacuugaagauuguggagauggaggcccacgacgucaaagacauacuccagaucaaguccgcaaaggaugacuggagccuggaugaaucucccuuaucagccagugagauuaaagaaaagguuaaagacaucuuucaggcucugggcaucuguaccaagauucuauauuucgauccucuccugccagugaaagaguuugaaaagcaagacagcuaccagcuuuggcacuugcuguauuccuacgagucugaugacucgacgagcggcaacgagacccucuaucgcauacuggaaaagaaauacgcguucaagagagagcaugcaaggaucuuagccaauguagcucugcaggaugacuacgggucccuuucaacaaaagccauucguaagaucuaucccaacauuaaagaaaaucaguacaguaaggcaugcgaguuggccggauauaagcacucuaaacucagccugacuaccgaagaacuagaggcucgggaacugaagaacaucauaccucuccugaaaaagaacgcccuucgaaauccaguggucgagaaaaucuugaaccaaaugauuaaugugguuaacgcacugaucgaaaagaacuccgagagagaugcggaggguaaaauuacaaaguacuuucauuucgacgaaaucaggauagaguuagcucgcgaacucaagaaaaaugcccagaagcgguaugagaugacucagaauauuaacaaagcaaagcuggaacaccagaaaaucucagagauucuucaaaagaaguuuggcaucaaaaauccgaccaagagcgauauaaucagauacaggcuguaucaggaguuggaacacaacggguacaaagagcucuacacaaaugcccccauugcucgcgacaugcuguucucuaagaacaucgaaauugagcauaucgugccuaaagcccgagucuucgacgauuccuuuaguaauaagacccuaacuuuccaccggauaaacagcaauaagggagaauauacggcauuugacuacauuacaucucugaacuccgaggaggaacucaaccaguaucugacccguguggagaaugcuuacaaaacuaagucaaucagucuuaccaaauauaagaacuugcugaaaaaggccagcgaaaucggcgaugguuucauuaauagagacuuaagggauacacaguacaucgcgaagaaagccaaggagauucucuuucaaguaaccaaaaacguucugucgacuuccgggucuauaacagaccgccuucgggaagauuggggccugguggacgucaugaaggagcuaaauaugccaaaauaucagagccucggacugacggagguggaagagagaaaggaaggcaacaaggucaccgugaucaaaaauuggacuaagaggaacgaucaucgacaccaugcuauggacgcauugacaguugccuucaccaaacccucauacauucaguaccugaaucacuuaaacgcucgcaaggaugagaauaacaaaaauuauagugugauccucgccauugaggaaaaggagacaaucaaaguaccuacuaacaaugggaagaacaagcgggucuuuauagaaccaauccccaacuucagacaaguggcuaaaaagcaccuggaggaaauuuuuaucucccauaaagcgaagaauaaaguugugaccaagaacgucaauaagccggccggaacggacaaacagcagauuacccuuacaccuaggggucagcugcacaaggagacuaucuacggcaaauaucaauacuaugugaacaaggaggaaaaaguaggggugaaguucgaugagcguaccauaacaaagguuucuaaucccuuguaccgcgaagcucuccugaaacggcuacaggccaacgacaaugacccaaagaaagcauuuacuggaaagaacgcucugagcaaaaauccuauuuaucuugaugagaccaagacgaagacacuccccgaaaaagucaaccugaccuacuuggaggaggacuucuccaucagaaaggauaucucaccagacaauuuuaaagaucuaaagagcauugaaaaagugauagaccagggcgugaagaggaucuuaauuaaacgacuccaggauuacgacaacgaucccaagaaggccuucgucgaccuggagaaaaauccuaucuggcuuaacaaggaaaaagguauugcaaucaagcggguuacuauaaguggggugucuaaugcccaaccacugcauaucggcaaagaucacuugggaaagacaacccucaacaaggagggcaaugaaauuccgguggacuauguauccacugggaacaaccaccaugucgcuaucuaccgcgacaaagagggaaaucugcaggagcagauugugagcuucuuugaagcgguugugagaacccagcaaggucuacccaucauagauaagacauauaaacaggaggaaggcuggcaguuccuguuuacgaugaagcagaacgagauguucgucuuuccuaaugccaccacuggguucaacccagcagagauugaccuucucgaucccaaaaauaagaagcugaucucgccuaacuuguuuagggugcaaaagaucgcuacaaaggacuacuucuuucggcaccauuuagaaaccaauguugagacagauaacgugcugaaaaauacuaccuggaagcgagaaggacucucaggccugaaagacauuguaaaggucagaaucaaccaccuuggugauauagugucuauuggggaguauuga

SEQ ID NO: 3335 - RNA, 4281 nt, Artificial Sequence
  Cas9 variant
augaagcacauccugggccucgaccuugggaccaacagcauuggaugggcccugauaaaacaggauuucgagaauaagcaaggugaaaucuugggcaugggguccagaauuauccccaugucucaggacauuuuaggagauuuuggcaaagguaacucagugagucagacagcugagaggacuaaguaccggagcguccgccgacugcgugaaagauuccuacucaggcgggagcgccugcauagaauccuuaauguucugggguuuuugccugaacacuaugcaucccagauagacuucacgaaaagguuuggaaaguucaaggaggagaccgaaccaaaacucguguacucuaacgagggcuuuaucuucaagaaaucguuugaagagaugcugucagauuucaagacacaucaaccgcagcugcucgaggacaauaaaaagauucccuaugauuggacuaucuacuauuuacggaagaaagcccugagccgcaagauugaaaaagaggaacuugcguggaucuugcugaacuuuaaucagaagcgaggcuacuaucagcuaagaggggaggaagaggaggaaaacccuaauaaacucauagaguucuacagucugaagauuguagacgugcuugcugaugaaccacaaaaaggaaaguccgacaucugguacucucugauuuuggagaacgguuggaucuauaggcggagcuccaagacaccccucuuugauuggaaagaaaagacacgugacuucaucgucaccauugaucugaaugacgacggcucagugaaaacugauaaggaggggaacgagaaacgcaguuucagagccccuggagaaaaugacuggacauuaguuaagaagaaaaccgagcaggaaauagauagcucuaggaagacggugggcacuuacaucuaugagacccugcucaaaaacccaaagcagaaaauuaaggguaaacuuguccggacaaucgaacgaaaauuuuacaagacugagcugaaacagauauuggagaagcaaaaagaguuccaccccgaacuacgccaggacgaucuguauuccgacugcgugagagaacucuacaagaauaacgaggcacaucagcugacccuuucaaagaaagauuuuguacaccuguucauggaggacauuaucuuuuaucaaaggccuuuggggagccagaagaguucuaucuccaacuguacacucgaguuccggaaauacaaggaugaaaauggaaccgaacacacgcaguaccugaaagccauuccaaagagcaacccguauuaccaggaguuucgcaucuggcaauggauguauaauuuaaacauuuacaaaaaggaagacgauacuaauguuacaaaggacuuccugaacaccaaagcugacuuugagucgcuauucgaguuucucaauaacagaaaggaaguggaucagaaagcacugcuuaagcauuucaaauugaaugacaagacucacagguggaacuaugucgaggauaagaaauaccccugcaaugaaacaaagaccaugauacugucucgucucgacaaaguggagaacaucuccgaugacuuucugacgcgggaaauggagcagaagauuuggcauaucaucuauucagugaaugauaaagucgaguacgaaaaggcccuuaagaguuucgcuggcaaaaacaaucuggaggacaacagcuucuuugaagccuucaagaaauuuccuccauucaaguccgaguacggcgcguuuucugaaaaagcaauuaagaaguugcucccccugaugcgaauggggaaauucuggaacuauaauaacauaagcgagcagucaaagaguagaauccaaaagauuaucaccggagaguacgaugaaaauauuaaggacaaaguuagggagaaggccauccacuuaacaacugaaaccgauuuucagggucugcagcuauggcucgugcaguauauaguauacggccgccacuccgaggcugccaugcuggggaaauggaacagcgcagacgaucuugaggaguucuugaaggaauuuaagcaacauucucugcggaauccuaucguggaacaggucauuacagagacucucagagugguuaaagacaucuggcagaaguauggaaacggcgcuaaagacuucuuuagggaaauucacaucgagcugggucgcgagaugaaguuaccagccgaggaacgagaacggcugacccgucagauaucagagaaugaaaacacaaauuucagaauuaaagcgcuuuuggccgagaugauggaugacaacaguguggagaaugucaggcccuuuagcccgaugcaacaggaaauccucaagauuuacgaggaaggggugcugaacuccgauaucgagauagaagacgauauccuaaagauuucuaaaaccgcacagccuucgagcuccgaccugaagcgcuauaaacucuggcuggagcaaaaguacaaaucacccuacacuggccagaucauuccacuuaauaaguuguucacgccugaguaugaaaucgagcauauaauuccccagagucgguacuucgaugacucuuuuacaaacaagaucaucugugaaagcgcuguaaauaaacugaaggauaacuauauuggauuagaguucaucaaaaagcucggcggguccauuguugagugcggaaacgguaaaucaguggccauacugaagcacgacgcuuacgaagauuuuaucaagaaacauuaugccaauaacagaagcaagaggaauaaacuucuguuggaggacauuccagaaaagaugaucgagcgacagaugaacgauacccgcuacauuucuaaauauaucuccggcguccucaguaauauagugcgggucgaagacgggacugacgagggagugaacagcaagaauaucguucccggcaacgguaagauuaccacacaacugaaacaggauugggggcuaaaugacguguggaacgaucugauccucccuagauucgagaggaugaaucaccugaccaacucuacugacuuuacagcauggaaugaaaaccaccagaaguuccuuccaacgguaccggucgaguuuuccaaaggcuucucaaagaaacguauugaucaucgccaccaugccuuggacgcucuggugaucgcgugugcaaccaaggaucacguuaauuuacucaacaaccagagugccaaaagcgacacuaagcgguacgaucugaagaaaaagcugaugaaauuugaaaagguggcuuacaaucacccccaaacaggagagagaauagaaagggaggccccuaaacaguuccuuaagccaugggagaccuuuacaauugacgcaaagaaccaucuagaaacuaucaucgucucguucaaacagaaucuccgagugauuaacaaggccaccaauuauuacgagaaauauguagaaaaggagggcacgaaagugaaggaacggguugagcagaaggggaccaacugggcuauacgcaaacccaugcacaaggagacagucuccggaaaaaucgaucugccuagaauuaaggugccaaaagguaagaucuugacugccaccaggaagucucuggacaccagcuucaauuuaaaaacuauuggcucaaucaccgacacggggauacaaaagauccucaaaaacuaccugcaguauaaggauaauaaccccgaacuugcauuuaguccggagggaauugaagacaugaauaaaaacaucgagaaguucaauaacggcaaagcgcaucaguccauuucuaaggugcgggucuuugagcuggguagcaaguucccuuuggggcaauccggcaauaaaaaggaaaaauacguugaggcugccaagggaacaaaccucuuuuucgcaaucuaucaggauaaaaauggcaagcgaucauacgaaaccauaccacugaacgaggugauugaaagacagaagcaggggcuaagcgugguagaccugaaaggagucgaugacuuuuaccuuagucccaacgaucucguguauguuccuucugaggacgagcuggaaaauaucuccaugaucgauuucaacaagaugagcucggagcgcauuuacaaaguggucucauuuacuggcaaucaaaucuucuuugugaggcaggacauagccacaucuguugugaacaaggcugaguucaguaccuugaauaaaauggaacgugccauugaugguacuaugaucaaggaaaccugcguaaagcugcagauugaccgguuagggaacaucuccaaaauauga

SEQ ID NO: 3336 - RNA, 4281 nt, Artificial Sequence
  Cas9 variant
auguacaacaucggccuggacauugggaccggaagcguggguuggugccucacagaugagaauggcuaucuucugaaggucaacagaaaagggaauaacggaaauacuuacaggaacuccgccuggggcguucgguuguucgaaucugcugacacggcagccgauugucgcauaaagcgaucaacccguagaagguauaaacggcgcagaacaaggaucauugaguuacggaagaucaugagugacaugauuaugcccaucgauccuaauuuuuacgcgcgccuggacgaggcuuuccuauggaacgaagauaaaagcgacaaggccaaggcaccauuucuccuguucaaugauaacgguuaugacgaugugaaauacuauacugacuacccgaccauauaccaccuucgaaagcaucuguuggaaacaaaagagaaggccgaucccagauuuaucuaucucgcucugcaccauaugaugaaauacagggggcacuuccuguuugagggacaguccuucgaagcaauugacaauaucgaggacaccuuuauugaacucgagcauuuaguaaacguguaugucaaggagaaggaagauacugacaauaacgccgagaauaacgcucuguaccaagaaaugaaaaacuaucuugccgauaauaaggugaaaaacaaggacaaaaaggaguacaucacagauaccuucauaaaagcggacuaugauaauaaguacucuaaggaauuggcagccgcuguucugggcuacgaguuuaacgugggcauuaucgucaaugacaacucgcuaacggaugaggacgggaaagcccucaaggcaaaauucgcugaugccaaguaugaagagaaagaagagaagcugucagacacucuuggagaacgguacuauauuaucgagacccugaagaaaaucuacagcuggaagguguugcacaguauucucggugacaauaaauaucuguccuacgcgaugguagauaaguaugagaaacacucugaacaguuaaaggcccugaaguaccucuuucauaaauacacaagccaggacgaguauuccgaguucuuccaccaggaaaagaacaaagaaggcaaguacauaguuaauuaugcaaacuacaucaaagggauuaagcgucuuucaaaugagacuaacaagaaauauaauaccaagcaacagcuguaccagaguaucaugaaaauauugggagagcgcgcugccgaugacgaaguguauaagaaaauucuagucgagauggaacaggagacauuucuggagaagaucaacaauguggauaacagcgcuaucccuuaccaacucaaccugauggaaauggacaaaauucuuacccagcagggcguguacuauaaggagcugagagauaauaaggaauugcuccugaaaauguuaacgucuaagaucccauacuaugucgguccccugaacaauaacuccaaugggaacaggaauuucgccuggaugacuaaaaaggacggaaaagagaacgaaaagguuuacccuuggaaugugaaggauguaguggacauugaugucacagcagaggacuuuauaacccggaugacuaacuauugcacauaccuaccaaaugagaaagugcuccccaaggaaucacugcuuuaucagcgauacauguugcuggaggaacucagccaaauccgcauugauggcagaaaacugaguaaggaggacaggaaagccaucaucaacgaccuuuucauuggcaaggggcggguuaaggugucugauaaagacuuuaaggaauaccugaauaaagucaacuaugugaagguaaauggaaaagguuacgauguuaccggcuaucaguccgacgauggguucgcuugugcguugagcucguacaacaaguuucgcagaauacucggacauaucgacgagcagaacgagaagaugauugaagauaucauuuauuggaucacgguguucgaggacaaagauauagucaagaggaaaaucaauaagcaauacgcagaccgucugucugccgaacaguuaaagaagauucugaaacuaaaguuuaagggcuggggucgguauuccucaaaacuccugaacgggaucaagggcgauaugggaaccacaauuaucgagaugcuugaagacgcugaugagcgauucgccuacugcgacuacuguccuaauuuuaugcagauaauuaacaaagacgagaagaucaaacagauuaucgaugacaauagaccaagguaugauggcacuaaggacuugcuggaugugauacaagacaugcacaccaguccggcaaaccgccgggggaucuggcagacaaugaaggccauugaagagaucauugaauacaugggagagaaaccccagcagaucuauauagaguucgcuagagaagaugacccuaaggccaaaaauaagagggcagauagccgcaaacgagcgauugacaaggcucucaagaaacugaaggaggaugucguggacgaauacaacgagaaaguuuauaaggaauuaaaacaauacgagaagcggcuggacgaggaaaagguguaucuuuacuuuaugcagaaugguaaagauuuguacuucccagacaaggagcucaaccuggaugaacuagagaaacuggaaaucgaccacaucauucccuauucccucucugaugacgauagccuggacaauaaggcccuuguauugaaaggcaacaaucagaacaaggggaauaagaucgucaaagaggcauucccucagcuguuuucaaacaguggaacugugaacuacuggaagaaucucaaaaaggccggcuuaauuuccgagaaaaaguauaacaaucugcagaaaaacaauguugaugacauacuuaccaaggguuucaucaaccgucaacugguggaaacaagacagauugucaagagcguggcuaauuugauccucgauuacuauaacgagcagauugacguaaucgaagugaaagccucucugucaaccaguguuaggaagaugcuaacuuacgagaaaaaggauaauaacggguuuuggauagaaaauaaagacaacugcauguucuauaagaaucgcgacaugaacgauuaccaucacgcacaugacgcuuaccuggccaauaucauuggccucuauauccaaaagaacuacccacggcugcagaaagagcuuaauuauagccaguacagaaggauuuggcgaaaguauuacgagaacacgaaaaacaauaacggagucaauugguuugcgacauugggcaaguucuccucuaacaaugaagaggccgauugguaugggcaagacaucauagcuuacaugcgcaaaaucuuuuguuaccgggaugugcugauuucgaagaagguggaagagaacaccggagcauucuauagcgagacuaaauaccccagagaagacaaggccgguuccaaauuagucccgcucaagcagggcaauaacaugcguggggcuaauaaccugaaagagcuugaugccaggaaguauggaggcuacaaggguggggaaaaagcauauuuuguucuggugaaguacugcaucgagaaagcgcuaaagaaaaaggugaaaaaggaauaucacauggaguucguagagauuccugucuacauagcccgcggcaucaagaauaaagacauuaaccucuacgauuaugugugugacauccugaaugaagcuaacaaaaauucaguugccgauguggagauuuugcggaacaaaguccccaaguaccagaugaucauaggagaaaacggcgaggaauauuaccuggugagugcaaccgagguuaucaauucuaaacaguuuguguuagggggagcuaaccaacaguauaauagacuccugaacuacauuaaguauggcaagaaugacaaauggcaguacauccagacagagcuucuggaugaacaauugauuggucucuacaaccugcuaaucgccaagauaaaagacgaguauaagggguucagcaaagaagcaguaaggauucaggagaauaacuccuuugacaagcuggaugucaaggacaaaaaggaguucaucgccgaaaugaucaaacuugugcagccagauucagacuacccuuaucucggaaaguacgcuaccggccugagcaaucgaaugggucggaaaacuggcgagaagguggggaagaaaauuacauuggucgauaagucuguuacgggacuguaugaacgcagaaccacuuucgaguuagaagacgauuccaguacaaaaagcugcuga

SEQ ID NO: 3337 - RNA, 4281 nt, Artificial Sequence
  Cas9 variant
augaagaacauccugggccucgaccuugggaccacaagcauuggauucgcccacauaguggaggaugaaaauaaagagaaguccgaaaucaaagagcugggugucagaauuguuucuuugacuacggacgaacaaucagauuuugagaagggcaaaaguaucaccacaaacgcuaauaggacuuuaaagcauggggcacggcugaaccuagaccgcuaccaacagcgacguaaguaucucauugaucugcuucagaaagccaaucugaucacccccagcuccauauuggcggagaacggaaagaauacaacccacucuacuuggcagcucagagcuaaagccgugacagaaaggaucgagaaggaagaguucgcacggauucugcuggccaucaacaaaaagcgcggcuacaagucgucaagaaaagcuaagaccgaggacgaaggucaagcaauugaugggauggccaucgcuaaaaggcucuaugacgagaauuuaacgccuggacagcugagccuucaguugcugcagcaaaacaagaaacuacucccagauuuuuaccggagugaccugcagaaggaguucgaucuuguauggaauuuucagaaacaguucuauccggacauacugacugauaucuuuuacaaggaauugcaaggcaagggcaaagacgccaccuccaaggcguucucuaaacgcuaucauuuugacacaacugaaaacaaggggagcaaagaguccgugcgacuccaggcauaccaguggagagccgaggcuauuucaaagcaacugaguaaggaagaggucgccuacguguuaaccgaaauuaauaacaaucugaacaacgcaagcggauaucucggugcuaucucugauagguccaaagagcuuuacuucaaucggcagacaguuggccaguaucuguacgccaaguugcaggaaaaccgucacaauucauugaaaaacaagguguuuuaucgccaagacuaccuggaugaguucgagagaaucugggaaacccaggcgagcuuucauaaagagcucacggacgaacugaagaagcagauuagggaugucgugauauucuaucagcggaaacccaagagucaaaaagggcuuaucucuuucugcgaguuugaauccaaggagauugagaucgaaaaagacggaaagacuauaacaaagaauauuggcgcccgaguaguuccuaaaagcucgccacuguuccaggaguuuaagaucuggcagaucuugaacaaugugauuuguaaacgcaaggguaucaggaaaaagaaaauuucugcaaagaccacucagcucgaucuguuaaacgaauccucacaaacaauauucagucuggacauggagugcaagcagcuacucuuugaugagcugaaucuuaaaggggaccuaaagagcgauaaaguccugaagcuccugggauacuccccacaggaaugggagaucaacuacaaucagcuugaaggcaacagaacccaaaaagcucuguaugaggccuacuugaagauuguggaaauggaggcucacgacgugaaggacauccuccagaucaaaucugccaaggaugacuggagccuggaugagucaccuuuaagugcauccgaaauucgggagaaagucaaggccauauuccagacgcugggcaucuguaccaaaauucuauauuuugacccacuccugcccguuaaggaguucgaagaacaagauagcuaccagcuuuggcacuugcuguauucuuacgagucagacgauaguacaagcgggaaugagacucucuaucgcauccuggaaaagaaauacgcuuuuaagagagagcaugcgaggauuuuagcaaacguggcccugcaggacgauuacggaucccuuucuaccaaagcuauccguaagauauauccuaauaucaaagaaaaccaguacucgacagccugcgagaaggcagguuauaagcacagcaaauugucccucacuaccgaggaacuggaggcccgggaacuaaagaacauuaucccacugcucaaaaagaaugcucugcgaaacccgguaguggagaaaauucuuaaucaaaugaucaacgucgugaaugccuugauagaaaagaacucagagagagacgcagagggcaaaauuacaaaguacuuccauuuugaugaaaucaggauugagcuggcgcgcgaauuaaagaaaaaugcucagaagcgguaugagaugacccagaacaucaauaaagccaagcucgaacaccagaaaauaagugagauccugcaaaaggaguucgggauuaagaaccccacuaaaucugacaucauuagauacaggcuuuaucaggaacuggagcacaauggauacaaggaauuguacacgaacgcaccuaucgcccgcgauaugcucuuuagcaaaaauauagagauugaacauaucguuccaaaggcucgaguguucgacgacuccuucucaaacaaaacacugaccuuucaccggaucaauagcgauaagggcgaguauacugccuucgacuacauuaccucucuaaacuccgaggaggaacugaaccaguaucucacacgugucgaaaaugcauacaagaccaaaaguaucagccccacuaaguauaaaaaccugcuuaagaaggcuucugagauuggugaugacuuuauaaauagagauuugagggacacacaguacaucgccaaaaaggcgaaagaaauucuguuccaagugacgaagaacguauuauccaccucagggaguaucacugaucgccuccgggaggacuggggccugguugaugugaugaaagagcuuaauaugccuaaguaucagagccugggacuaacagaagucgaggaaagaaaagacggcaacaaggugaccgucauuaagaauuggacaaaaaggaacgaucaucgacaccaugccauggacgcucucacuguggcauuuaccaagccaucguacauccaguaccugaaucacuugaacgcccgcaaagaugagaauaacaagaauuauuccguuauacuggcuaucgaggaaaaagagacgauuaaggugcccaccaacaaugggaaaaacaagcggguauucaucgaaccgauuccuaacuuuagacaagucgccaagaaacacuuagaggaaaucuucauaucucauaaggcuaaaaauaaggugguuacuaaaaacacaaauaagcccgcgggaaccgacaagcagcagauuacacucacuccaaggggucagcugcacaaagagaccaucuacggcaaguaucaauacuauaucaacaaagaggaaaagauuggggugaaauuugacgagcguacgauagccaaggucagcaauccuguguaccgcgaagcacuucugaagcgguugcaggccaacgauaaugaccccaaaaaggcauucgcuggcaaaaacgcccucucaaagaauccaaucuaucuggaugagaguaaaacaaagacccuacccgaaaagguaaaccugacuuaccuugaggaggacuuuuccauuagaaaagauaucucuccugacaauuucaaggaucucaaaagcauugaaaaggugaucgaccagggaguuaaaaggauacugaucaagcgauugcaggcauacgauaacgaccccaaaaaggccuuugucgaucuggagaagaauccgauuugguuaaacaaagaaaaggguaucgcuauuaaacgggugacaaucuccggggugaauaacgcgcaaccccuccauauaggcaaggaccaccugggaaaaaccacucuuaauaaggagggcaaggaaauuccugucgacuauguuucaaccgggaacaaccaccauguggccaucuaccgcgauaaagagggaaaucugcaggagcagaucgugagcuucuucgacgcaguagucagagcucagcaagguauuccaaucauagauaagacauauaaacaggccgaaggcuggcaguuuuuguucacgaugaagcagaacgagauguuuguguuccccaaugccaccacuggguuuaacccugcugaaauugaccuccuggaucccaaaaauaagaagcuaaucaguccaaaccuguucaggguucagaaaauugcaacaaaggacuacuuuuuccggcaccaucuugagaccaauguggagacagauaacauccucaaaaaugucacuuggaagcgagaaggacugucuggcuugaaagacauagugaagguuagaauuaaccacuuaggugauaucguguccaucggggaguauuga

SEQ ID NO: 3338 - RNA, 4281 nt, Artificial Sequence
  Cas9 variant
augaagaacauccugggccucgaccuugggaccacaagcauuggauucacucacauaguggaggaugaaaauaaagagaaguccgaaaucaaagagcugggugucagaauuguuucuuugacgaccgacgaacagucagauuuugagaagggcaaaaguaucagcacaaacgccaauaggacuuuaaagcauggggcucggcugaaccuagaccgcuaccaacagcgacguaaguuccucauugaucugcuucagaaagcaaaucugaucaccuccucuucgauauuggccgagaacggaaagaauacaacccacucaacuuggcagcucagagcgaaagcugugacagaaaggaucgagaaggaagaguuugcccggguacugcuggcaauuaacaaaaagcgcggcuauaagagcaguagaaaagccaagaccgaggacgaaggucaagcuaucgaugggauggcaauugccaaaaggcucuacgacgagaauuuaacgcccggacagcugucccuucaguugcugcagcaaaacaagaaacuacucccugauuucuaucggucugaccugcagaaggaauuugaucuuguguggaauuuccagaaacaguuuuacccagacauccugacugauagcuucuauaaggaguugcaaggcaagggcaaagacgcuaccuccaaggccuuuucaaaacgcuaccauuucgacacagcggaaaacaaggggagucgagagagcgucagacuccaggcauaucaguggagggccgaggcuauaucuaaacaacuguccaaggaagagguggccuacguuuuaacugaaauuaauaacaaucugaacaacgcaucaggauaccucggugcuaucagcgaucggaguaaggagcuuuauuuuaaucgucagaccgugggccaguaccuguaugcccaguugcaagaaaacaaacacaauucucuaaagaacaaagucuucuaccgccaggacuaucuggaugaguuugagagaauuugggaaacacaggcguccuuccauaaggagcucaccgaggaacugaaaaagcagaucagggacgugguaaucuucuaccaacggaaacuuaaaagccagaaggggcugauuucguuuugcgaguucgaaucuaaagagauagaaaucgagaaggauggaaaaacgauuacuaaguccaucggcgcccgaguugugccgaagucaagucccuuguuucaggaguucaaaauauggcagauucucaauaacgucacauguaagcgcaaagguaucagaaagaaaaagagcuccgcaaaaucuaccgaacuggacuuauuuaaugagccuagccaaacuaucuucucacuggauauggaaugcaagcagcuacucuuugaggaacugaaccuuaagggggacuugaaaagugauaaggugcugaaacuccugggauauuccccacaggagugggaaauuaauuacaaccagcuugagggcaauaggacacaaaaggcucuguacgaggccuauuugaaaaucguggaaauggaggcucacgacgucaaggauauucuccagauaaagagcaccaaagacgacugggcccuggaagagucucccuuaucagcaagugaaauccgggagcgcguuaaggccauuuuccagacgcugggcaucuguaccaaaauccuauacuuugauccucuccugccagugaaggaguucgaggaacaagacagcuaucagcuuuggcacuugcuguacuccuaugaaucugaugacucgacaagcgggaacgagacucucuacaggauucuggaaaagaaguaugcuuuuaagagagagcaugcgaccauauuagcaaauguaacacugcaggaugacuacggaucccuuucaacuaaagccauccguaagauuuaccccuauaucaaagagaaccaguacaguaccgcuugcgaaaaggccgguuauaaacacucuaaguugagccucacaaccgaggaacuggaggcacgggagcuaaagaauauuaucccucugcucaaaaagaacgcccugcgaaacccaguggucgagaaaauacuuaaucaaaugaucaacgugguuaaugcuuugauugaaaagaacuccgaaagagaugccgagggcaaaaucacuaaguacuuccauuuugacgaaauuaggaucgagcuggcacgcgagcucaaaaagaaugcgcaggaacgguaugagaugacgcagaacauaaauaaggcuaaauuagaacaccagaagauuucagggauccugcaaaaagaguucggaauuaagaacccgacaaaaagcgauaucaccagauacaggcuuuaucaggaacuggcccacaauggcuacaacgacuuguacacuaauaccuauauacccaaggagcuccuguucucuaagaacaucgauauugagcauaucguguccaaagcacgcgucuuugacgauaguuucagcaauaagacacuagccuuucgagaguucaacauuaaaaagggugaaucuaccgcuuuugacuacaucacuucccugaauaacgaagaggaacucaaccaguaucugaaucggguggagaacgccuacaaaacaaagaauauaucaccagcaaaguauaaaaaccuuuugaagaaagcuagugagauuggggacggcuucaucaaucgugaucugagagacacgcaguacaucgccaagaaagcgaaggaaauuuuauuucaaguaaccaagaacguucucagcacuucgggauccaucacagauaggcugcgcgaggacuggggccuuguggaugucaugaaagaacugaauaugccaaaguaucagucucuagggcucaccgagguggaggaacggaaagagggaaacaaggucacagugauuaaaaauuggacuaagagaaacgaccacaggcaucacgccauggaugcucugaccguugcauucacgaagcccagcuacauacaguacuugaaucaucugaacgcccgaaaagacaagaauaacaaaaauuauucagugaucuuagcuauugaagagaaggaaaccaucaaaguaccuacaaacaacgguaagaauaaacgcgucuuuauugagccaauccccaacuuccggcaaguggccaagaagcaccucgaggaaauauuuaucagucacaaagcaaagaauaaaguugugacuaagaacaccaauaaaccggcgggcacagauaagcagcagauuacucugaccccuagagggcagcuucauaaggagacggucuacggaaaauaucaauacuaugugaacaaggaagagaaaaucggcguaaaguucgacaaagaaacaauugccaagguguccaaucccguuuacagggaggcucuguugaagcgucuccaggccaacgauaaugacccuaaaaaggcauuugcugguaaaaacgcccugucuaagaauccuaucuaucuagaugaggcaaaaaccaagacucugacagaaaaggucaaccuuaccuaccucgaggaagacuucagcauacgcaaagacauuucccccgauaauuucaaggaccugaaaucaaucgagaaggugaucgaucagggggugaaacggauuuugauaaagagacugcaggacuacgauaacgaccccaaaaaggccuuugucgauuuagaaaagaauccaaucuggcucaacaaagagaagggcauugcuaucaaaaggguuacuauuagcggagugaauaacgcgcaaccucugcacaucggcaaggaccaucuugggaaaaccacacugaacaaggagggaaaggaaauaccaguggauuauguaaguacggguaauaaccaccacgucgccaucuaccgagacaaagagggcaauuugcaggaacagauugugucuuucuuugaggcaguugugggggcucagcaaggacucccgaucgucgauaagaccuauaaacaggccgagggcuggcaguuccuguuuacuaugaagcagaacgaaauguucguguuucccaaugaggccacagguuucaacccugcugaaauugaccuacuggaccccaaaaauaagaagcaaaucuccccaaaccuuuuucggguucagaaaauagcaaccaaggauuacuucuuucgccaucaccucgagacaaauguggacacugauaacguacugaaaaauaccacguggaagagagaaggguugagcggcuuaaaagacauugucaaggugaggaucaaccaucugggagauaucgugucgauuggcgaguauuga

SEQ ID NO: 3339 - RNA, 4284 nt, Artificial Sequence
  Cas9 variant
augaagaaaauccugggccucgaccuugggaccagcuccauuggaugggcccuggugaacgaggcugaaacaucugaggaaaagucaaguauaaucaaauugggugucagaguuaaucccuuaacuguggaugagcugcagaacuucgaaaagggcaaaagcauuacgaccaaugcagacaggacagccgggcgguccaugcgccgaaaccuacaacguuacaagcucagaagggagaaucugaucgagguacuuaaggaauauaacuuuauuacugaugagaugauccugucugaaaauggaaaccggaccacauucgagaccuaccgcuugagagcgaaagcugccguggaggaaauaucgcucgagcaguuugcaaggguccugcugaugaucaauaagaaacggggcuauaagucaagccgcaaagccaagggugcugaaaacgggacucucauugacggaauggagguggcaaagaaaauguacgaugaaggcaucacaccuggcgaguuaugccugcagcuuuugaccgccgggaagcgauauuucccagacuuuuacagaagugaucugcaggcugaguucgacaggauuuggaauuuucaaaaacaguucuauccggauucccuaaucgacaagguuaaagaugaagugcggggaaagaacaaaucucagacgugggccauacucgcgaaguacuuugucuggaaggagguggaaaauagcuggaacgaggaagaggcacagacucgucgcguagagaaagaauacagacugguugguauuaagaggggcgugaaacgggaggaacuuaagcuggagaauuuccaauggcgagucaaagccuuguccgaacgcaugaaccccgaggagcucgcuaucgugcugcaggaaauuaacgagcagaucucaaauaguagcggguauuuaggagccaucucugacagauccaaggaacuguacuuuaacaggcagaccgugggccaauaucagauggcaguccucgauaauaacccuaauauuggucuucggaacaugguuuucuaccgccaggacuaucuggacgaguuuaauacaauaugggagaagcaagcugaauuucacaaagaguugacugaagaucuaaagaaagagaucagagacauugugaucuucuaccagaggcgucugaagucacagaaagggcucauaaacauuugugaauuugagcggcgacagaucgagguagaaaucgauggaaagaagaaaauuaagaccaucggcagcagagugauuccaaggaguucuccccuguuccaagaguuuaaaauauggcagacacuuaaugacaucgaagucuccgugcugggcguuaagaacaaacgcaagaagcaggaugacaauagcaccacguugcucgauucggccgagaacauugacucucugaaauuaaaugugucccggccucuggaugcggacgaaaagucacuacucgccaaagagcuguucaucagagauaaacuuacuaagagugacgucuugaagcugcucuuuaacaauccacagaaccugaaccuuaauuucaaaaacaucgacgggaauaggacaggaagcgcacuguaucaggcuuuuuccaagauuuuggagauaucuggucaugaaagcaucaacuucaagaaaucagccgaugagauuguggaacaaguaaagaccaucuuuagugcucucggcuggaauacugagguucugugcuucgacuccgaaaaagaguuagauaagcagcccuacuuuaaacuguggcaccuacucuacagcuucgagggggacucuacaccuaccggagauggcaaccugauucagaagaucgccgaccuuugugguuuugaaaaggauuaugcaucaauauuggccaauaucacguuccaagaggacuacgggagucugagcaccaaagcuauucgcaagauccucccacaucugaaagauggcaaccaguaugacguggcgugcgaauacgcaggauauaagcacuccaaaucuucguuaaagaaggaggagauuaaaaauaagguccugaaagauaaacuugaauugcucccgaagaacagccugcgaaaucccguggucgagaagauccuaaaccagauggugaauguuauaaacgccauuaucacaacuuacggcaagccugacgaaauucggaucgagcuggcucgugaacucaaaaagaaugccaaagagagagaggaacugaccaaguccauaguggauacaacuaaaacccaugaggggaucagggcaauucuucagaacgacuucggaaugucacacguaagucgcaacgccaucauucgguauaaguuguacgaggaacugaaagacaaugguuacaagacauuauauucuaacaccuacaucccaaaggaaaaacucuuuagcaaggauuucgacauagagcacauuaucccccaagcuagacuguuugaugacuccuucucaaauaaaacucuugaggucaagagcaucaacauugaaaaaggcucuaagacggccuaugauuuuguggaggaaaaguacggggagcagggacugcaggaauauuugaauaggugugagguucucuuccgagacaaaaagacaaaacugcgcaagcuaaaaaugcaagaguccgaaaucccugagggcuuuauugaucgggaccugagaaacacccaguacauagcaaagaaggcgcucaguaugcugaaugaaaucugcaggcguguggucgcuacuaccggugccauuacagaugagcuucgcgaggacuggcaguugguggauguaaugaaagaacugaacugggagaaguauaaaguguuagggcucguugaauacuucgaggacaaugauggccggcugaucggaagaauuaaggacuggaccaaaaggaacgaccaucgacaccaugcaauggaugcccuuacugucgcuuuuacaaaggacguguucauccaguacuuuaauaacaagaaugccagccugaaaccagauacgaacgaagcagcuauacggaauaaguauuuccaaaacggcaaagccauucccccgaugucucuagacgaguuucgcgcggaggccaagaaacaccucaacgauacccugaucuccaucaagacuaagaauaaaguggucacaauuaacuugaauagaaccaagaaaaagaacgggaucaauaaaaagcagcagcagacaccuaggggacaacugcacuuagaaacuguuuacgguucacauaaacaguauguggugaaggaggaaaagguaaacgcuaguuucgacgcagccaaaauagcuaccgucaauaagcccgccuaccgggaugcacuccugcgaagacuucaggagaacggcaaugacagcaaaaaggcguucacggggaaaaacucgcuggauaagcagccagugugguuggacgccaagcaaaaugaauguguuccugagaaagugaagaccgucaugcucgagacaguguauacuguucgcaaacccauugaugaaaagcugaacguggacaaaguagucgacgcuaggauccguaagcuacugcaggaucggaucaaggaguacggaaaugccaaauccgcauuugcuaaccuugacgaaaauccaauuuggcucaacaaggagaaaggcauaaccaucaagagagugucugugagcgguauuucaaaagcccagagucugcacgaaaagaaggauaaagacgggaauuucaucuuggauaaggacuccaggcgcauucccgucgauuuuguuaacacaggcaacaaucaucacguggcaaucuaucgaaaaccuguacuggacaagaaaggacaagccguguucgaugagaacggcgaguuaaaguuugaacucgaggaagucgugguuucuuucuuugacgcugugacuagagucaaucugagccagccaauaaucgauaaagacuacaagcgguccgagggguggaaguuccuuuucucaaugaaacagaacgaguacuucguguuuccgaaugaaaagaccggauucgaucccaaagagauugaccuguugaacccugaaaauuaugcgcucaucagcccaaaccuguucaggguucagaagauugccaguaaagacuacguguuucgccaucaccuagagacggucguagcagaucguaaggaacugcaagagaucacauggaagagaauaucuucccuuagcauucucaaucggaucaucaaagugaggguuaaccacauuggccagaucgugaugauaggugaguauuga

SEQ ID NO: 3340 - RNA, 4284 nt, Artificial Sequence
  Cas9 variant
auggccaagcccaaagacuacaccaucggccuggauauugggacaaacagcgugggaugggucguuacugacgaucagaauaacauacucagaaucaaggguaaaaaggcuauuggcgcaaggcuuuucgccgaggggaaaguggcggcugaacggcgcuccuuucgaacgacccguagaaggcugucucggcgcagauggaggaucaaguuguuagaggaacuguucgacaaggagauugccaaaguagauccuucauuuuucgcacggcuacacgaaaguuggaucagcccaaaggacaaacgcaagcgauauuccgccauaguguuuccgucucccgaggaggauaaaaaguuccaugaaucguacccuacaaucuaucaccucagagacaagcugaugaaagaugaccaaaagcaugauauuagggagaucuacauugcuguccaccagaugaucaaagcacggggaaauuuucuucaugacgaaucaguggagacuuaucguagcggcaugaguucccugggugggcgcucugagagaaccauauugagcguucagacacucgaagaacugaacgaucuguucgccgaaaaugagggaaccgaagaggcuaagcucaacguggccuccgcggagcagauuaaugacaucuuaacuggcggccaccugaacgcagacucacaaaaagaaauugggaaucuuuugcugccaaguagcuuucccucuuucgaugacaaggccaaagagaagcaggucaagaaacuaaucaagaacguggcuacaaauaucuccaaagccuggcucggauacaaggcagauuuuucaaccauucugaaccuugcuaauguagacaaagaucagaagaagauauucgccuuugcgcugcaggguggcgacgaagaggauaaaguucaagaauuggagagccuccuggagcagagucagacggacaucguggauagguuaauugaaauccggcacgccauaguccugucugagauugugccuguggggaugacucucuccgaagcaaugaucgacaaguaugaucagcauaaagaggaccuuaucacccugaaggcugucauucgaaacacaaaagacaagaagaaagccgcuaaguugcaagccaucuacgaucuauacguuaauaaccgccacgcagaccuggccaaagcuaugaagcucacuggaauuaaaaagagaagcgaacugcuugauccagaggagcugaagaaagcgauaucgucuuugcucgacgauucccccgaagcaguggagaucaagcagaugcuggaagagaaaaccuucuuaccucugcagaggucaaacaauaacggcguaauuccaaaucaacuacaucagguggagcucgacgaaaucaucaagaaacagaguaaguauuacccguuccuggccgagaaaaaccccgaugaaagcgaggaagcucagaagaaggccccuacaaaacuugacgcauugcugaccuuucgggucccauauuacgugggucccaugauuacgaaggaggagcaagaagcccaggaugggcacuccuucgcuuggaugguucgcagagacccucaggaucacgaggccauaacuccauggaauuuugagaaaaagguggacaaaauggcaucugcgacacaguucaucaagaggaugaccacuaaggauacauaucuccugggagaggacguccuucccgcuagcucacugaaauaccaauuguuuaccgugcucaacgaacugaauaacuuacguguaaauggcaagaaacugacgagugacgagaaggagcagguuauugaaggccuauucaaaaagcagaagaccgugaaagccgauaaguuugucaaauauuggcaggcaaagcauaucggggccgacauuaaagugaagggacucuccgauccgagcaaguucaacucuacaaugucaacuuacaucgacuuuaaaaagauauucggugaucaacugaaugacgucaaccggcagaaugauuuugagaaaaucauugaauacaguaccaucuucgaggaccgaaagauucuugaagauaaauugagagcugacuuugccuggcugagcgaggagcagaucaagcagcucugcaggcugcgcuuacaaggcugggggcggcuguccgauaaacuuuugacaagacucacugacgcagauggacagaacgugcuggaaaggcuauggaacucuaaugacaacuucguucagauagugucggacccuaauauuaaggcuaagaucgagcaagaaaaccagaaacugcuccgcgauggccagagcgacgaugccguagaguccauucuggacgaugcguauaccucaccccagaauaagaaagccauccgacaagucaugcgggugguucacgacauagugaaggcuugugaugguaacgucccagcaaaauucgccaucgaguuugcucguagucaggaagacgauccuaagagaacaaccgccagggugaaucagaugcagaagauuuacgaccaaaucucugaugagguagugagccaggggguuaaagaacagcuuuccggcaugaagucauugaaagaccgcuauuaccuguauuucaugcagggaggccgggacgcauacacuggggcgaaguuaaacauugauagacucagcgacuaugauaucgaccauauaaugccccaaucuuuugucaaagaugacucccuggauaauagggugcuuguggcccgagcugucaacaaucagaagagugacaagguuccagcccuguuguucggaaacaaagugguggcagaucucgguauuacgguacgcgagaugugggacaaguggcagaaacugggcaugaucagcaagcggaaacuaucuaaucugcucacagaucccgacgcucugaccgaauacagagcccaaggguuuaucaggcgucagcuugucgagacuucccaggugauuaaguugaccgcaacaauccugcagucagaguucccugauaguaagauuauagaaguuccagccaaauacaacagcaucgugcgcaagcaauuugacuuauauaaaucgcgggaggucaaugacuaccaccaugcuauugaugcguaucucuccaccaucgugggaaacuaccuguaucagguuuacccgaaucuuagaaggauguucguguauggcgaauuuaagaaauucucuagcaacgccgaggaaucagcauacgacguaguccgacgggugaagaguaugaacuuucuggaugaccuacuccgcgguacucacggggauaauauuuacugcagauccacaggcgagaucguguucaacaggaaugacauaaucucuaagcugaaacaggcuuauagcuuuaagcagauguuggucacgcaagagguuuucaccaaaaaguccgcccuguucgaucagacuguguaccccucaccugaacgggacagcaaaaagcgaaguggauuaauuccacgcaaaaagggcauggauacagagaucuaugggggauacucugguaacaaggacgccuauuuuguacucgcugaagcagugaaagagaagggccacacccugcagauugucggggugcccaucagagcccuuaauacacugaaaaacuccgcgaauuacagcgaaaaguugcucgagauaauuaaaccucagguuauguucaacaaggauacuggaaagccaaucaaaggcaucaaggacgugaaaauucugauggauaagauacccuguaggcaaccgguccuagagggugaaucguauuacaugcuggcuucaucuaaauaccguuauagucuuaagcagaucucccucagccagaugucuaugaaguacauucuggacuauaucgacgauccuaauuuuaacaaacaugagaugauuaauaucgaccagcaagaugaaaaggagugcuugcugagcguguacgacgagauauuagagaaaauggauaaguaucucccacuguucgacauccgguccuuuagaaagaaacuucacgaugggagggacgccuucauugcacugcccguugccucagaagaaaagaaaccuggcaagguggaugucauccgcaaaguauugaagggacuccaugcuaacgcagacauuaccaaucuggccgagcuaggcuuugggacggcggcucugggagcccuugugaguaccggcgguaucaaaauaagcgaugacgcaguuuucauuuaccagucucccacagggcucuuugaacgaagagugaaggucuccgaccuguugaaauga

SEQ ID NO: 3341 - RNA, 4287 nt, Artificial Sequence
  Cas9 variant
augaagaaaauccugggccucgaccuugggaccacaagcauuggauccgccuacgugcuggaggcugaaaagucugcagagcagacuaaaauagucuauuuggguacgagaaucauuuuaucaagugccgaugcggaaaacuucagcaagggccuguccugcucucccaccacagacaggacuuuuaaacggucgaugcgccgacgucuacaaagauacaagcagaggcggucaagccucauccagcaguucaagaaaauugggaucauaaccaauacagagcaaaucauucgcgaaccuaucagugagacccacgagcugcuuagaauuagguccaaggcuguuucugaacgggugagccuggaggaauuugcccgcaucuugcucacuauaaacaaacgaagaggauauaaguccaauaggaaaacaucaaagaguaccgaggaggauggcaagcugguagacgcaauggccgugacgaaagaacugauuaagcucaaaaagacuccaggucaguacauguucgagcgguuuaaacgugggaaguaugcugaaaucgauuucuacccguuugacuuaauuaacgagcugaaacagaucugggaaguccagggacaaaaguaucccgaugugcuuaccgaggacuugcugagcucucuacucaagcagaaaacaggcaaggcaaaagagcugaucuacuccaagucagaucuuaauccugccgaaguuccaauugacuaccagaaaggcaagaagcugcgcaaaacuauauugaacaaguauuucgcuuacgagagcagaagucucgccgcgaccaauaucauucccguggaacaggucaucacagcaauaguggccauuuguaaacaaaucaacaauucuuccggguaucugggagcuaucggugauaggagccggguauuauacgccaacaaucagaccauuggccaguaucuguacgagcgaaucaaggcaaacccucaugaccgcauuagaggggaaguuuucuauaggcaagauuaccucgacgaguucgaccggauaugggagugccagcagaauuacuauccagcuauccuuacgaacgaucgcaaacaguuuauuagaaauaggaucaucuucuaccaacguccccugaagucgaagaaaucugaauuggccuuuugugaguucgaaucccgggagguggaacacaacggaaagaaauauacugagggccuacaugucgcgccuaagucaaguccaguguuccagcacuuucgacuguggcagagacucggucagauugaggugagcccgcugaggaaauggaacaagcaauccaaugaacuuuucgagcagcagaacgacacagaucaggaacgcauacugaauaccgaggccaagcaaaaauuguuuucuuaccucaaccuguuagaccaucugacugauaaugagauccuaaacauucucggguauagccccgacaaguggaaaaucaauuuccgggaaauuaucggaaacagaacaaauaacucaaugaugaaggcauuuuucaauaugaaagagaugaccgauggcgaacagauaaacugggagaagaaucugacgaaaaucaccaacggccagagucuuauuuccccugaacagaucgucgacuugauuaggcaauuuuucgagcgcgaggggaucacaacuagccugcucuacuuugauccaaccacagacaauuuccgagaacagucucacuauucacuguggcaccuucuguacaguuacgaggaugacaacagccccacuggaaccacauccuugugcaagacccucgcuaagcgguaugguauaccucaugaacuguguccauuacuggccucucuaacuuuugagccccaguacggcucgcucagcacgaaagcuaugcguaagauucugccguucaugcaagaaaacggguaugacaaagccugcgagcuugcaggauacagacacuccgccuggacaaccaaggaggaaaauacugagaggaccuugaaaaacucacugccucuccugcgcaagggcaguuuacggaaucccguuguggaaaagauccugaaccagaugacacauguaauuaauacccacaucucugaguaugguaacccagaugaaauaagaaucgagauggcuagggacaugcaggcgaauagcaaacagcgaaaggcaaugacuacagccauugcugaggccacgaaacgcaacacccaauuuaucgaagagauucagaaggaauuuggguucaauccuuccaaaaacgaucuuaucaaguacaaguuguggaaagagcucgcaccccugggcucaaagacucuauauagcaauacauacauaccaaaagaggaacuguuuaccgccaaguucgagauugaacacaucaucccccgggcucucuuuuacgacgauucuuucuccaacaaaacacuggagcuuaauagugugaacaaguugaagggaaauaaaacugcccuggacuauauggauaccuuaagccaggaacaggcaaacgacuacauuaucagagucgaggagcucaagaaaauuggcgcgauaacgcaagcuaaguauaaaaagcugcuuaucagggaaaaagaucugggggacgauuuuaccaaccgugacuugacaaauacucgcuacauuauccggcaugccgcagauaugcuccuucaggugaccccuucuauuguucacacaaacggauccaucacugccauacuaagaagggacugggagcugcucgacauccugaaggaacuuaauuugccaaccuaugagucaauugaucgaaagaucagugacccgaaagaaaagcugacggagagcguggagcggaaagauggucaggcuauuaagaugaucaaagacuggucgaagcgcgaugaccauagacaccaugccauggaugcauuaauaacagcucucaccacuaggaagcacguccaguaccugaacggcaaucggggagccgaagagacagacaaagugcaaaagcugcagcagcugaaagcgcuacgaaagcaacucauuggauccgauggccacuucauucccccuaugcaugacaucagaguacaggccaaagaagcucugucucgcguuaucauaagcaccaaggcaaaggguaaagugacuaccccaaacacaaauaucauuuguucaagggauaagacgaccgggcguaaaaucuaugucaagcagacuacauugacaccccggggcgcccugcacaaagagaugcaguacggaugcaaccauuacuauuuagaaaagcaaauuccuaucggcaguaagcucaccgaggaggaaauaagacugguguccucuccaaaaaucaggagcaugcuuuccgagcgccugcaggcuuacaauaacgaccccaagucagccuuuacugggcgaaauagcauggauaaaaagccguuggaagacaaaaacaagaagcucgucuauaccgacaaaaaggugaaacagacgauucuggcaaauagauucguuaagcgggauagggugaacaguaaacuagaccuggauaagguaaucgacacaggaauuaaacgcauccuugagcguagacucaagcaguacgguggcaaguaugagaccgcguuuucugaucuggaaaauaacccuauaugguugaacgaggaaaaagggauugccaucaaguccguccggaucagggggaaaaauaacacuauuaccauccgccaaacaaauacuugucgaauaaaguacguggcuaacgacaauaaccaccaccuggccguuuaugcauuaccagauggcagcauugaggacgauaucgugucguucuuugacgcugucgaaagaucacggaaaggucuccccauuaucgauaagcauaagaaucagucucugggguggaaauuccuuuuuagugugaagcagaacgaguacuuccuguugccucagcaaggcgagaaaauagacauugacaccggagaaaucuccaugcagacaacguucagccccaaggaucucucuccagaguacaucaugaauccugacaacuaugccgaacuggcaccccacauuuuuaggguacagagcaucuccaaaaccccacagggcaaucgcgaugugagaauuuaccuauucaagcaacaguauauaucagggagucagaaggacagccugcaucuuaaaggaaucacucacaggcaaauuucuuccgccaaggaucucgcuggccugguuaaaauccgggucaaccauuugggucguaucguggcggugggggagaaguga

SEQ ID NO: 3342 - RNA, 4287 nt, Artificial Sequence
  Cas9 variant
augaagaaaauccugggccucgaccuugggaccgccagcauuggauccgcuuacgugcuggaggcagaaaagucugccgaucagacaaaaauagucuauuuggguacuagaaucauuuuaucaagugcggacgcugagaacuucagcaagggccuguccugcucucccacgaccgauaggacauuuaaacggucgaugcgccgacgucuacaaagauacaagcagaggcggucaagccucauccagcaguucaagaaaauugggaucauaacuaauaccgaacaaaucauucgcgagccuaucagugaaacacacgagcugcuuagaauuagguccaaggccguuucugagcgggugagccuggaagaguuugcacgcaucuugcucaccauaaacaaacgaagaggauauaaguccaauaggaaaacuucaaagaguacagaagaggacggcaagcugguagaugccauggcugugaccaaagagcugauuaagcucaaaaagacgccaggucaguacauguucgaacgguuuaaacgugggaaguaugcagagaucgacuucuacccguuugauuuaauuaacgaacugaaacagaucugggagguccagggacaaaaguaucccgacgugcuuacugaagauuugcugagcucucuacucaagcagaaaaccggcaaggccaaagagcugaucuacuccaagucagaccuuaauccugcugagguuccaauugauuaccagaaaggcaagaagcugcgcaaaacaauauugaacaaguauuucgccuacgaaagcagaagucucgcggugacuaauaucauucccgucgagcaggcaaucaccgccauaguggcuauuuguaaacaaaucaacaauucuuccggguaucugggagccaucggugacaggagccggguauuauacgcaaacaaucagacaauuggccaguaucuguacgaacgaaucaaggcuaacccucaugaucgcauuagaggggagguuuucuauaggcaagacuaccucgacgaauuugaucggauaugggagugccagcagaauuacuauccagccauccuuaccaacgaccgcaaacaguacauuagaaauaggaucaucuuuuaucaacguccccugaagucgaagaaaucugaguuggcguucugugaauuugagucccgggaaguggagcacaacggaaagaaauacacggaaggccuacaugucgccccuaagucaaguccaguguuccagcacuuccgacuguggcagagacucggucagauugaggugagcccgcugaggaaaugggauaagcaauccaacgagcuuuuugaacagcagaauaacgcagaccgcgaggggauacugaauacugaagcuaagcagaaauuguucucuuaucucaaccuguuagaucaucugacagacaaugagauccuaaacauucucggauacagccccgauaaguggaaaaucaauuuucgggagauuaucggcaacagaaccaauaaccugaugaugaaggccuucuuuucaaugaaagaaaugacugacggcgagcaaauagauugggaaaagaaucuuacaaaaaucaccaacgggcagaguuugauuuccccugagcagaucgucgaccugauuaggcaguucuuugaacgcgagggaaucacgaccagccuccuguauuucgauccagcuacagacaauuuucgagagcaaucucacuacucacuuuggcaccuguuguacaguuaugaagacgauaacagccccacugguaccacaucccucugcaagacucuggccaagcgguacggcauaccucaugaguuauguccacugcuagcaucucucaccuucgaacgucaguaugggucgcugagcacaaaagccaugagaaagcuguugcccuuuaugcaggagaaaagguacgacgaggcuugcgaacuggcgggauaucgccacuccgcauggauuaccaaggaggaaaaugccaaacggacucucaagaacaagcugccguuacugagaaaaggcucacuuaggaacccuguuguggagaagaucuugaaucaaaugacgcauguaauuaacacacacaucgcugaauacgguaaucccgaugagauacgaaucgaaauggcccgcgacaugcaggcaaacaguaaacagcggaaggccaugaccgcugccauuacugaggcaaccaaaagaaauacacaguucaucgaggaaauucaaaaggaguuuggguucaacccaucuaagaaugaucucaucaaauauaagcuguggaaagaacuagcgccucugggcaacaagacccucuacagcaauauauacauucccaaagaggagcuguucacugcuaaguuugaaaucgagcacaucauuccaagggcccuuuucuaugacgauuccuuuucaaacaagacauuggaacugaauagcgugaacaaauuaaagggaaauaaaacggcacucgacuaccuggauacccuuggccaggagaaggccaacgacuauauccugcgugucgaagaguugaaaaagauuggggcuauaacucaggccaaauacaagaagcuccugauccgcgagaaagaucuaggagacgauuucacaaaucgggaccugaccaacacaagauauauuaucaggcaugcagcugacaugcuccuucaggugacucccucuauuguucacaccaacgguuccaucacggccauacuucgacgggauuggggcuugcuggacaucuuaaaggaacucaaucugccuaccuacgagaguauugaucgcaaaaucagcgacccagaagagaaacuuacacaaucuguggauagaaaggacgggcaggcgauuaagaugaucaaggauugguccaaaagggacgaucaucggcaccaugccauggacgcucugauaacugcacuaaccacacgaaagcacguccaguaucucaacggaaauucaggcgccgaagagacugauaaagcucagaagcuggagcaauugaaagcccugagaaagcaguuaauugguagugacgggcacuuuaucccgcccaugcaugauauccgcgugcaggcaaaggaagcgcucagcaggguaauuauaucgaccaaaguuaagggcaaagugacgacaccuaacaccaauaucauuuguucccgugacaagacuacaggacggaaaaucuacgucagacaaaccacucugaccccaaggggcgcccuucaccuggacacaaaguacgggauuaaccgcuauuaccaggagcgagaagugucuaucggaagcaaguugacgcaggaggaaauaagacucgucucaaguccccauauccaguccauucugcuagagcggcugagggcuuucgauaauaacccuaaaucugccuuuaccggucgcaauagcguggacaagaaaccacuugaggauaagaacaaaaagcucguuuauacugacaagaaagugaagcaaacaauccuggcaaaucguuucguaaaaagagaucaggucaacuccaaguugaaucuggacaaagugauugauaccggcaucaagcggauauuagaagggaggcuccagcaguacggaggcaaauaugagacagcuuuuucagaccuggaaaacaaucccauuuggcuuaacgaggagaaggguaucgccaucaagagcguucgcauucgagggaaaaacaaugcaaucccgauacaccaaacugauaccugcccuauugacuacguggccaacgauaauaaccaccaucuggcugucuauguguugccagacggcacgaucgaagacgauauuguaacauucuuugacgcgguggagagaagucggcagggacuccccaucguugauaagaauaaaaaccagucucugggcuggaaguuccuauuuuccauaaaacagaaugaauacuuccugcuuccucaacaggccgagaagauugacaucgauaccggggaaaucagcacucagaccacauucucgcccaaggaccucucaccagaguacauuaugaacccugauaauuaugcagagcuggcuucucacaucuuuaggguccagaguauuuccaaaacuccccaaggaaaccgcgacgugagaauauacuuguucaagcagcaguauaucagcggcucucaaaaagauagcuuacaucugaaggguauuaccuacaggcagaucuccucagccaaagaccucgccgaacuggugaagauccgggucaaucaccuugggcguauuguuagugugggagagaaguga

SEQ ID NO: 3343 - RNA, 4287 nt, Artificial Sequence
  Cas9 variant
augaccaagaaaauccugggccucgaccuugggacaacuagcauuggaugggccuacgugauagaguccgauaaccccgacgaaucugagaucaagcagauuggugucagaguuaauccucugacgaccgaugaacaaacaaacuucgagaaaggcaagccauuuucaaucaauaaagaaaggacuuugaagcgcggggcucggcgaaacuuagaccguuauaaggauagaaggaauaaccugauugaggugcucaaaaaggcaaauauccuaagucaggacagcauacugaccgaggaaggacagcacacaacccaucagacuuggcaacuucgggccaaagcggcuguagauaagaucgagaaagaggaacuggcccgcguguugcucgcaauuaacaagaagagaggcuacaaauccucuaggaaggccaaaaaugaggacgaaggucaggcuaucgaugggauggcagucgccaagcggcuguaugacgagcagauuacaugcggacagcugguguaccaacucuuacgcgaaggcaaaaagucgaucccggauuucuaucgaucagaccugcaggcugaguuugauaaaguuuggaacuuccagaagcaguuuuaccccaagauacuuaccgacgaauuuuauaaagaguugaagggcaaagggcaaagagccacgagcgcgcuguuuuacaagacuuacaauuucaacaccgcagagaauaaaggaaguagggaagagaagaagauucaggccuauaaauggcgguccgaagcuaucucucagcaacuagagaaggaagagguggccuuuguccucacagagauuaacaauaaccugaacaauagcuccgguuaccuuggcgcaaucucagaccguaguaaagaacuguauuucaacaagcagacuguggggcaguacuuguaucagcaacuccaggagaaucgccacgcuagacugaaaaaccagguauuuuacaggcaggauuauuuagacgaguucgaagccaucuggaaggaacaagcgaagcaucacaccgagcugacagaggaacucaaagccgagauucgggauauaaucauuuucuaccagcgaaaacuuaaaagccagaagggacugaucucuuucugugaguucgaaucccgcgagauacagauugacggcaaaaagaagaccaucgguuugagaguugcaccuaaaucaagcccacuauuucaagaguucaagaucuggcagaaucugaacaaugugcucgucaggaaaaaggggagucggaaacgcaacgugaagcaggaaauucagggaucucuguuugaagaggaaaaagagaucuucguguuugaucuugagacgaaggaaaagcuguucgaggaauugaaucucaaaggcaaccuguccgcuaauaaggucauugaguuacugggccauaaacccacugaaugggagauaaacuacagcgcccuagaggggaauagaacaaaccaagcucucuauaaugccuaccugaagauccuugacauugaaggauaugaugaggacuugcugaaacucucggauaaggacgauaucaacguugcagaccugaagaccccugccucugaaaucaaaaacauggugagggacauuuuucagguacuugguauauccacugauauccuggaguucgacgcugaauuggauggcaaggacuuugagcagcaagcgucauaccagcucuggcaccuguuauauaguuacgagggggaugacagccaguccggaaaugaaaaacuguaugagcuacucgaaaagaaauucggcuuuaagaaggagcacucucaggugcuggcaaacgucacacuuagcgaugacuacgguaauuugucaaguaaagccaugcguaagauuuacccauucaucaaagagaacaauuauuccaccgcuugcgaacuggccggguaccggcauagcaagcacucucucacgaaagaggaaauugagaaccgaccccuggaugacaaguuagaacugcuuaagaaaaauucauugagacaaccugugguugagaagauccucaaccagauggugaaugucgugaacagucugcuagagaaaaauaggaaggaaaacccagauuuucgcuucgacgagauacggaucgaacuggcaagagagcucaaaaagaaugccaaagaaagggcugagaugaccacaaacauuaauagcgccaagacugagaacgaaaagaucuucaaacugcuucaggcagaguuuggcuugaagaacccgacccgcaaugauauuauccgauaucggcuguacgaagaguuaaagaacaauggauauaaggaccucuacacaaacaaauauauaccccgugaaauucuguucuccaagcagguagacaucgagcauauuaucccucaaucuagacuuuuugaugacucguucagcaauaagacuauaguuuacagggagaccaaccuggauaaaggcaaucagacagcguuugacuacaucgauuccaaguaugggaacgaaaaaguggaggaauacauuuugcgcaucgaggcucuccacgacgccuggaagaaaaauaaggaggaaggaauuucaaaggcaaaauaucagaagcugcugaaaaaggagaccgaaaucggugauggcuucauagagcgggaccuaagagaaagucaguacauugccaaaaaggcuaaggagaugcucuuuaaaaucacuaggucugucgugagcacguccgggucaaucacagauaagcugcgagaggacuggggacuuauuaacaucaugaaagaauugaaucugccaaaguaucgcagcuuaggccucaccgagaugcaagaacggaaauucggucagaaggucgaggugauuaacgauuggacuaagagaaaugaccacaggcaucacgccauggaugcacugaccguugcuuuuacaaaacauaaccacauacaguaccuuaauuaucugaacgcccguaagaacgaaaaucauaaacuacacaacaauaucauugcgaucgagaaccucgagaccgaaacuaugauugacaauaacgggucuaagcgccggguguucaaagcccccaugccuaauuuuagacaaguagcuaaggagcaccuggaaaacgucuugaucucccauaaagcaaagaauaaggugguuacgaaaaacaagaauaaaauagccggcaagguggcugcccaggagacacugaccccaaggggacaguuacacaaagaaacugucuacggcaaguaccaguauuacgugaacaaggaggagaaaaucgggacaaaguucgacgaagagaccauuaauaaaguaaguaacccccaauaucgaaagcuccugcuugaacggcugagcgcaaauggaaacgauccgaaaaaggcguuuucugguaagaaugccuuguccaaaaacccuaucuaccucaacgagacaaagacugagaccgugcccgaaguugucaaacugacguggcuagaggaagacuauucaauucgcaaggauaucaccccagacaauuucaaagaugagaagaguauagacaagauucuggaugaaggcgugaaaagaauccuuaagaaaaggcuccggaagaacgacaaugauccuaaaaaggcuuucagcgaccuggauaaaaaccccaucugguugaaugaggagaaggggauuucgauaaagcgagugacaaucuccggagucaacaaugccgaaccacugcauuacaaaaaggaccacuuuggcaacgacauuuuagaugagaaaggugacaagauccccguugauuucgugucuacugggaauaaccaccauguggcaguauauagagacgaaaaaggcaaucuccaggagaacauugucagcuuuuucgaagcugugauccgcguuaaucagggacugccuauaaucgauaaggccuacaaccagcaccuuggcuggcaauuucuguucaccaugaagcagaaugagauguuuguguucccaaacgagaaaucaggguuuaacccgcaggaaauugacuugcucgaucccaguaauaagaaaaagaucuccccuaaccuguucaggguccagaaaaugucuaaggugauuuacggaaauagcccaguucgugaguauguguuucggcaucaccuagaaacaaacguagacgagaagaaagaacugaaggauaucacuuucaaaaauauaaagucccuuggcuacuucgaggacauugucaaagugagaaucaaccaucucggugauaucgugucagucggggaguauuga

SEQ ID NO: 3344 - RNA, 4293 nt, Artificial Sequence
  Cas9 variant
augaagcacauccugggccucgaccuugggaccaacagcauuggaugggccguggucaaagaggcucagaaugauaacgaacaauccgagauaguugacguggguguaagagugaauccccugacaacugaugaaaagacgaacuucgagaaaggcaagccuaucucuaccaaugcagacaggacauugaaacggucagcccgccgaaacuuacagcguuacaagcugagaaggaaggaacuaauugagcuccugaaagagcaucagcuuaucaguacugauaccauucugacagaaaaugggaagggaaccacuuuucagacauuggagcuccgggcgaaaagcgcuaaggaaaagaucucccuggaggagcuggcccgcgucuuccucaccauaaacaagaagagaggcuauaaaucuucgaggaaggccaaaaaugaagacgagggucaauuaaucgaugggauggaaauugcaaagcggcuguacgaggaaaaccuuacgacuggacaguugucacugcagcuacucaaagagggcaagaaaagccugccagacuauuaccgcagugaucuucaguuugagcuggacaagguguggaauuuccaaaagcaguuucacuccgauaucuugaccgacgaguucuaugcucagcucaaaggcaaggggcagcgagcaacaucugcccuguuuuuagcuaaauaccaaauuuauacugccgagaacaagggaagcagagaagauaaaaagcugcaggcguaccaguggaggguugacgcacucuccaaggagcuuacccgggaacaacuggccuucgugaucacagagauaaauaacaauuugaacaacucaagugguuaccuaggcgcuauuagcgaccguucuaaagagcuguauuuuaauaacgaaaccgucggggaguaccucuggaagcagaucgccgcaaauccgcauacgucccugaaaaaccagguguucuaucgccaggauuaccuugacgaauuugagcaaauuuggaagacucagucagcuuucuaucccgaaauccugacagaugaguugaaaaaggagcucagagacguaguuaucuuuuaccagaggaagcugaaaagccagaagaguuuagugucuuucugcgaguucgaaaauaaagaaauugagauaaagaaagaggauggaaccuccacuaagaaggucaucggccugaaaguggccccuaagagcucgccacuauuucaagaguucaaaauuuggcagaaccucaauaacgugcugauccggaagaaagguucuaagaccaaaaaggucgcgaagaaucagcaggccguucuuuuugaagaagagaaaaccauauccgaauuggaccuggaggcaaagcaagcucucuucaacgagcugaaucuuaaagggaaccugaaggccgauuauuguuuggaaauucucggauacucacccaaagagugggaaaugaauuacagugugcuggagggcaaccgaacgaauaaggcuuuauaugaagccuaccugaagaucaccgaccuagagggcuaugaugccaaaaaccaccucaagguaaaacugaacaaggacgagguggaacuugaugacuugaaagucccugcaagcgagaucaaggacauggugcaggcuauuuuuaaggaagcggggaucaauacagauauucugcauuucaacgcagagcucgacggaaaagauuuugaaaaucaggccuccuaccagcuguggcacuuacuguauucuuacgagggugacgauagcaagucaggcaacgagcuuuuguauaaacuccuggaaacuaaguucggguuuaaaaaggaguacgcucaaauacuagccaauguuagucuguccgacgauuacggaagccucucuaccaaggcaaugcgcaaaauccacccauauauuaaggaaaacaaauucucaacagccugcgagcuggcuggcuacagacauaguaagcacagccuuacuaaagaggaaaaugacaacaggguguugaaggauucccuggaggucuuaaagaaaaauucucuccggcagcccgugguagaaaagauccugaaccagaugaucaaucuuguuaacgcccuguugaaaaaguaucgcaccgagaauccuaacuuuaaauucgacgaaauuagaauagagcucgcaagggagcugaagaaaaaugcggaggaacgugcuaacaugacagccaacaucaauaaggcaaagaccgaacaugagaaaauuaucaagauucugaaaaacgaauuuggucuaccaaauccgacucggaacgauaucauacgauacagacucuaugaggagcugaaggccaauggguacaaagaccuuuauacgaacaucaagauuccccaagaaaaguuguucacaaaagagaucgauauugaacacaucauaccuaagucgaggguguucgacgacagcuuuuccaauaaaacccugucauuccgcaagacuaacuuagauaaaggcgagcggaccgcuuuugacuacauggaaaguaaguucggagccgauaagcucgaggaguacgucgcaagaguggaagaccuguauaaaaauaacauuaucucuaaggcuaaauaccagaaacuucugaaaaaggagagcgaaauuggcgauggguuugucgagagggaccuacgcgagacacaguauaucgccaagaaagcgaaggaaauacuccugcagaucaccccaaauguguuguccacuucaggagguauuacagaucgacugcgggaggacugggauuuaaucaacguuaugaaagaacucaaucugcccaaguaccgugcccuuggccugacgcaaauggaggacagaaaauaugggcaacagguggaaguaauuaccgauuggacuaagaggaacgaccaccgccaucacgcuauggaugcauugacagucgccuucaccaaacauaaucacauccaguaccucaacuaucugaacgcucggaagaaugagaagcauaaagagcacagcaacauaaugggcauucagcagcuagaaacaaucaaggugacugacaaaaauggaaacgagaagagaguuuuuaaagccccuaugccaaauuuccgacaggugaccaaggcauuucuggaaaacauccuuauuucucacaaggcgaaaaauaaggucgugacgaaaaacaagaauaaaguagccgguuccaacaaggugcaggagguucucacacccagggggcaacugcauaaggaaacagucuacggcaaauaccaguauuacgugcagaaggaggagaaaaucggagcuaaguucgacuuggaaacuauuaaaaagguggccaauccgcuguaucaaaguuuacucaagaaacgccuggaggaaaacggcggggauccuaagaaagcauuuaccggaaagaauagccuugcuaaaaaccccauauaccuggacgauacacagacugagcaguugccagaaaaggucaaacucguuuggcuggaaaauucuuucuccauccggaaggacauuaccccugagaacuuuaaggaugaaaaacuaaucgacaagauucuggaugagggugugaaaagaauccuuaaggaaaggcuccagucauucggcaaugacgccaaaaaggcauucagugaucuggacaagaaccccauaugguugaacaaagagaaggggaucacgauuaaacgugugacaaucagcggaguagccaaugcugagccauuacacaccaagaaagaucaucugggcaaggaaauucucgacaaggaggguaaacccaucccugucgacuuuauaucgacuggguccaaccaccacguggcgguuuaucgcgaugaaaagggcaaucugcaagagaaaguggucucuguguucgaagccguugugcgggcaaaccagggacuuccaauuaucgacaagacauacaaucagcaucugggcugggaguuuuuguucaccaugaaacagaacgagauguuuguauucccgaaugaaagcacuggguuuaaccccaaugauaucgaccuacuggauccuaagaacaagagaauuauaucaccaaaucucuucaggguccaaaaauuuaguaagcugcaguauggaaacuccuucgugcgagaguuuguguuccggcaccaucuugaaaccacagucgaggaccgcaaagaauuacagggcaucacguacaagcagaugaaaaauucuaccuucuuuaacgauauuaucaagguuagaauuaaucaccugggugacaucgugagcauaggggaguacuga

SEQ ID NO: 3345 - RNA, 4293 nt, Artificial Sequence
  Cas9 variant
augaagcacauccugggccucgaccuugggaccaacagcauuggaugggccguggucaaagaggcucagaaugauaacgaacaauccgagauaguugacguggguguaagagugaauccccugacaacugaugaaaagacgaacuucgagaaaggcaagccuaucucuaccaaugcagacaggacauugaaacggucagcccgccgaaacuuacagcguuacaagcugagaaggaaggaacuaauugagcuccugaaagagcaucagcuuaucaguacugauaccauucugacagaaaaugggaagggaaccacuuuucagacauuggagcuccgggcgaaaagcgcuaaggaaaagaucucccuggaggagcuggcccgcgucuuccucaccauaaacaagaagagaggcuauaaaucuucgaggaaggcuaaaaaugaagacgagggucaauuaaucgaugggauggaaauugccaagcggcuguacgaggaaaaccuuacgacuggacaguugucacugcagcuacucaaagagggcaagaaaagccugccagacuauuaccgcagugaucuucaguuugagcuggacaagguguggaauuuccaaaagcaguuucacucccauaucuugaccgaugaguucuaugcucagcucaaaggcaaggggcagcgagcaacaucugcccuguuuuuagcuaaauaccaaauuuauacugccgaaaacaagggaagcagagaagacaaaaagcugcaggcguaccaguggaggguugaugcacucuccaaggagcuuacccgggaacaacuggccuucgugaucacagagauaaauaacaauuugaacaacucaagugguuaccuaggcgcuauuagcgaccguucuaaagagcuguauuuuaauaacgaaaccgucggggaguaccucuggaagcagaucgccgcaaauccgcacacgucccugaaaaaccagguguucuaucgccaggacuaccuugaugaauuugagcaaauuuggaagacucagucagcuuucuaucccgaaauccugacagacgaguugaaaaaggagcucagagauguaguuaucuuuuaccagaggaagcugaaaagccagaagaguuuagugucuuucugcgaguucgaaaauaaagaaauugagauaaagaaagaggacggaaccuccacuaagaaggucaucggccugaaaguggccccuaagagcucgccacuauuucaagaguucaaaauuuggcagaaccucaauaacgugcugauccggaagaaagguucuaagaccaaaaaggucgauaagaaucagcaggcgguucuuuuugaagaagagaaaacaauauucgaauuggaccuggaggccaagcaagcacucuuuaacgagcugaaucuuaaagggaaccugaaggcuuauuacuguuuggaaauucucggauacucccccaaagagugggaaaugaauuauucagugcuggagggcaaccgaacgaauaaggccuuauacgaagcauaucugaagaucaccgaucuagagggcuacgacgccaaaaaccaucucaagguaaaacugaacaaggaugagguggaacuugacgauuugaaagucccugcaagugagaucaaggacauggugcaggccauuuucaaggaagcugggaucaauacagacauucugcacuuuaacgcggagcucgauggaaaagacuucgaaaaucaggcaagcuaucagcuguggcacuuacuguacuccuaugagggugaugacucuaagagcggcaacgagcuuuuguacaaacuccuggaaacuaaguuuggguucaaaaaggaguacgcccaaauacuagcuaauguuucacugagugaugacuauggaucccucagcaccaaggccaugcgcaaaauccauccauacauuaaggaaaacaaauuuucuacagcaugcgagcuggccggcuauagacacucaaagcauagucuuacuaaagaggaaaaugauaacaggguguugaaggacagccuggaggucuuaaagaaaaauucccuccggcagcccgugguagaaaagauccugaaccagaugaucaaucuuguuaacgcucuguugaaaaaguaccgcaccgagaauccuaacuucaaauuugaugaaauuagaauagagcucgccagggagcugaagaaaaaugcagaggaacgugcgaacaugacagugaacaucaauaaggcuaagaccgaacacgagaaaauuaucaagauucugaaaaacgaauuuggucugccaaauccgacucggaacgacaucauacgauauagacucuacgaggagcugaaggccaauggguauaaagaucuuuacacgaacgaauacaucgagaagcaagacuuguucacaaagaauauugauaucgaacacauuauccccaaaucuagggucuucgacgacucguucagcaacaagacccuguccuuucgcaaaacuaauuuagauaagggcgagcggaccgcauucgacuauauagaaucaaaauuuggagccgauaagcucgaggaguacguggcuagagucgaagaccuguauaagaacaauauuaucaguaaagccaaguaccagaaacuucugaagaaagagucugaaauuggcgauggguucguggagagggaccuacgcgagacacaguauaucgcaaagaaggcuaaagaaauacuccugcagaucaccccuaacguuuugagcacuuccggagguauuacagaucgacugcgggaggacugggauuuaaucaaugugaugaaggaacucaaccugccaaaauaccgugcccuuggccugacgcaaauggaggacagaaaguaugggcagcagguagaagucauuaucgauuggaccaaaaggaaugaccaucgccaccaugcgauggaugccuugacuguggcuuuuacaaagcacaaccauauacaguaccucaacuaccugaaugcacggaaaaacgagaagcacagagagcacucaaauauuaugggaauccaacagcuagaaaccaucaagguuacagacaaaaacggcaaugagaagaggguguucaaagcccccaugccuaacuuucgacaggucacuaaggcuuuccuggaaaaugugcuuauuagccauaaagccaagaacaagguagugaccaaaaauaagaacaaaguugcagguucuaauaagguccaggaggugcucacgccacgcgggcaacugcacaaagaaaccguguauggcaaguaccaguauuacguccagaaggaggagaaaaucggaggcaaguuugacuuggaaacaauuaaaaagguugcgaacccccuguaucaauccuuacucaaaaagcggcuggaggaaaaugggggagauccgaagaaagccuucacugguaagaacagucuugcuaaaaauccuauauaccuggacgaugcccagaccgagcaguugcccgaaaaggugaaacucguguggcuggagaacagcuuuucuaucagaaaggacauuacaccagagaauuucaaagaugaaaagcuaaucgacaagauucuggaugagggcguaaaaaggauccuuaaggaacgucuccaguccuucgggaacgacgcuaaaaaggcuuuuucagaucuggacaaaaacccuauaugguugaauaaggagaagggaaucgccauuaaacgcgucgcaaucaguggcguggccaacgcugagcccuuacauacuaagaaagaucaccuggguaaggaaauucucgacaaagagggcaagagcaucccaguugacuucauaucgaccgggaauaaccaccauguggcggucuaucgggaugaaaagggaaaucugcaagagaaagugguuuccguguuugaagccguagucagagcaaaccagggccuucccauuaucgacaagacguacaaucagcaccuggggugggaguucuuguuuacaaugaaacagaacgagauguucguguuuucuaaugaaagcaccggauucaacccuaaugauaucgaccuacuggauccaaagaacaaaaagauuauaucaccgaaucucuuuagggugcaaaaguucaguaaacugcaguacggcaacuccuuuguccgagaguucguuuuccggcaucaccuugaaacuacaguggaggaccgcaaggaauuacaggguaucaccuauaaacagaugaaaaauucugcauuuuucaacgauauuaucaaaguaagaauuaaccaucuagggggaaucgugagcgucggcgaguacuga

SEQ ID NO: 3346 - RNA, 4293 nt, Artificial Sequence
  Cas9 variant
augaaggacauccugggccucgaucuugggaccaacagcauuggaugggccguggucaaagaggcucagaaugacaacgaaacauccgagauaguugaucugggugugagaguaaaucccuugacuacggacgaaaagaccaacuucgagaaaggcaagccuaucucuacaaaugcagauaggacuuuaaaacggucagcccgccgaaaccugcaacguuacaagcuaagaaggaaggaacucauugagcugcuuaaagagcaccagcugaucaguaccgacacaauuuugaccgaaaaugggaagggaacuagcuuucagacacucgagcugcgggcgaaauccgcuaaggaaaagaucucucuggaggagcucgcccgcguguucuuaaccauaaacaagaagagaggcuauaaaucgucaaggaaggccaaaaaugaagaugagggucagcugaucgacgggauggaaauugcaaagcggcuuuacgaggaaaacuugacgacuggacaacugagccuacagcuccugaaagagggcaagaaaagucuuccagauuauuaccgcuccgaccugcaguuugaguuggauaaggucuggaauuuccagaagcaauuucauucucacauccucaccgacgaguucuaugcucagcugaaaggcaaggggcagcgagcaacaagcgccuuauuucuggcuaaauaccagauuuauacugccgagaacaagggauccagagaagauaaaaagcuccaagcguaccaguggaggguggacgcacuuucaaaggagcugacccgggaacaguuggccuucguuaucacagagauaaauaacaaucuaaacaacaguagcgguuaccugggcgcuauuucugaccguuccaaagagcucuauuuuaauaacgaaaccgugggggaguaccuguggaagcaaaucgccgcaaauccgcauacgucacuuaaaaaccaggucuucuaucgccaggauuaccuggacgaauuugagcagauuuggaauacucaagcucaguucuauccccagaucuugacagaugaacucaagaaagagcugagagacgugguaaucuuuuaccagaggaaguuaaagagccagaaaagucugguuucuuucugcgaguucgaaaacaaggagauugaaaucaaaaaggaggauggaaccuccacuaaaaaggugauaggccuaaaggucgccccuaaaagcucgccacucuuucaggaguucaagauuuggcagaaucugaacaaugugcuuauccggaaaaaggguucuaaaacaaagaaagcggccaagaaccagcaagcaguguuguuugaagaggaaaagaccauauccgagcuggaccucgaagcuaaacaggcccuguucaaugagcuuaaccugaaggggaauuugaaagcugauuauugucucgagauucugggauacucacccaaggaaugggagaugaacuacagugucuuagaaggcaaucgaacgaacaaagcccuguaugaggcauaccuaaagaucaccgaccucgaaggcuaugaugccaagaaccaccugaaaguuaaacuuaauaaagacgagguggaguuggaugaccugaagguaccugcuagcgaaaucaaagacauggugcaggcgauuuuuaaggaggcagggaucaacacagauauucuccauuucaaugccgaacuggacggaaaggauuuugagaaccaggcuuccuaccaauuauggcaucugcuuuauucuuacgaaggugacgauagcaaaucaggcaaugaguugcucuauaagcugcuagagacuaaauucggguuuaagaaagaauacgcccagauacuggcaaacgucagucucuccgacgauuacggaagccugucuaccaaggccaugcgcaagauccacccauauauuaaagagaauaaguucucaacagcuugcgaacuugccggcuacagacacaguaaacacagcuugacuaaggaggagaacgacaauagggugcugaaagauuccuuagaaguucucaagaaaaacucucugcggcagcccguggucgagaagauccuuaaucaaaugaucaaccuggugaaugcauugcucaagaaauaucgcaccgaaaacccuaauuuuaaguucgacgagauuagaauagaacuggcgagggagcugaaaaagaacgcugaggaacgugccaacaugacagcaaauaucaacaaagccaagaccgagcaugaaaagauuaucaaaauucuaaagaaugaguuuggucucccaaacccgacucggaaugauaucauacgauacagacuguaugaggaacuuaaagcuaacggguacaaggacuuguauacgaauaucaaaauuccccaggagaagcuguucacaaaggaaaucgauauugagcacaucauaccuaaaucgaggguauucgacgacagcuuuuccaacaagaccuuaucauuccgcaaaacuaaucucgauaagggcgaacggaccgccuuugacuacauggagaguaaauucggagcagauaagcuggaagaguacguugcuagaguggaggaccuuuauaagaacaauauuaucucuaaagccaaguaccagaaacugcuaaagaaagaaagcgagauuggcgauggguuugucgaaagggaccuccgcgagacacaguauaucgcgaagaaggccaaagagauacuguugcaaaucaccccaaacgugcuguccacuucaggagguauuacagaucgauuacgggaagacugggaucucaucaaugucaugaaggagcugaaccuucccaaauaccgugcucugggcuugacggaaauggaggacagaaaguaugggcaacagguggaaguuauuaucgauuggaccaaaaggaaugaccaccgccaucacgcaauggaugcccucacuguggcuuucacaaagcauaaccacauacaguaccugaacuaucuaaaugcccggaaaaacgagaagcauaaggagcacagcaauauuaugggaauccaacagcuggaaaccaucaaaguaacagacaagaacggcaaugagaaaagagucuuuaaggcaccuaugccaaacuuccgacaggugacuaaagcguuucuugaaaauauucucaucucucacaaggccaagaacaaaguugugaccaagaauaaaaacaaggucgcugguuccaauaaagugcaggagguacugacgcccagggggcaauugcauaaggaaaccguguacggcaaguaccaguauuacguucagaaagaggagaagauuggaggcaaauucgaccuggaaacaauaaagaaagucgccaacccguuauaucaaagucuccugaagaagcgccuugaggaaaaugggggagauccuaaaaaggcauuuacugguaaauacagccuggcuaagaaccccaucuauuuggacgaugcccagaccgagcagcucccagaaaaagugaagcugguguggcuagaaaauucuuucuccauucggaaagacaucacaccugagaacuuuaaggaugaaaagcugauugacaaaauccuugaugagggcgucaagagaauacucaaagaaaggcugcagucauucgggaaugacgcaaagaaagccuucagugauuuggacaagaaccccaucugguuaaacaaggagaaaggaauuacuaucaagcguguuaccauuagcggcguggcuaaugcggagccacugcacacgaaaaaggaucaucucgguaaagaaauccuggacaaggaggggaagcccauaccuguggacuuuauuucgacaggcuccaaccaccacguagccgucuaccgcgaugaaaaaggaaaucuucaagagaaggugguuucuguguucgaagcagucgugcgggcuaaccagggccugccaaucaucgacaaaaccuauaaucagcauuuggggugggaguuucuauucacuaugaagcagaacgagauguuuguuuucccgaaugaaagcacaggauuuaaccccaaugauauugaccugcucgauccuaaaaacaagagaauaaucucaccaaaucuguucagggugcaaaccauuaguguagucaaguacggcaacgccaucgugcgagacuuuaaauuccggcaccaucuugagacuaccguggaagauaagaaagaguuacaggguaagacauaccagcagauuaaaucccugucuccccucaaugacaucauaaagguccgcaucaaccacuugggggauauuguuagcgugggagaauauuga

SEQ ID NO: 3347 - RNA, 4293 nt, Artificial Sequence
  Cas9 variant
augaagcacauccugggccucgaccuugggaccaacagcauuggaugggccuacgugaaagaggcugaaaaugauacagagacuuccgaaauagucgaccuggguguuagagugaaccccuugacgaccgaugagaagacaaauuucgaaaaaggcaagccuaucucuacuaacgcagacaggaccuuaaaacggucagcccgccgaaaucugcagcguuauaagcuaagaaggaaggagcucauugagcugcuuaaagaacaucaacugaucagugagaacacaauuuugaccgaaaaugggaagggaacuacauuucagacccucgagcugcgggcgaaaagcgcuaaggagaaaaucucccugggcgaacucgcccgcguauucuuaacgauaaacaagaagagagguuacaaaucuucgaggaaggcaaagaaugaggaugaagggcagcugaucgacggaauggagauugccaagcggcuuuaugaagagaacuugacuaccggccagcugucacuacaacuccugaaagagggcaagaaaagccuuccagauuacuaucgcagugaccugcaguuugaauuggauaagguguggaauuuccagaagcaguuucacuccgacauccucacagaugaguucuacgcucaacugaaagggaagggacagcgagcaacuucugccuuauuucuggcuaaauaucagauuuacaccgccgaaaacaaggguagcagagaggacaaaaagcuccaggcguaccaauggagggucgaugcacuuuccaaggaacugacacgggagcaguuggccuucgugaucaccgagauaaauaacaaucuaaacaacucaaguggcuaucugggggcuauuagcgaccguucuaaagaacucuacuuuaauaacgagacgguuggagaauaucuguggaagcagaucgccgcaaauccgcauacuucccuuaaaaaccaaguguucuaccgccaggacuaucuggaugaguuugaacagauuuggaauacacaggcucaauucuacccccagaucuugaccgacgagcucaagaaagagcugagagaugucgugaucuuuuaucagaggaaguuaaagucacagaaaagccugguaaguuucugcgaguucgaaaacaaggaaauugagaucaaaaaggaggacggcacuucuaccaaaaagguuauaggucuaaagguggccccuaaauccagcccacucuuucaagaguucaagauuuggcagaaucugaacaauguccuuauccggaaaaaggggucgaaaacaaagaaagcggccaagaaccagcaggcaguguuguuugaagaagagaagacgauaucugaacuggaucucgaggcuaaacaagcccuguucaaugagcuuaaccugaagggaaauuugaaagcugacuacugucucgaaauucugggcuacucccccaaggagugggaaaugaacuauucaguguuagagggcaaucgaaccaacaaagcccuguacgaagcauaucuaaagaucacagaucucgagggguacgacgccaagaaccaccugaaagucaaacuuaauaaagaugagguugaauuggacgaucugaaggugccugcuagugagaucaaagaaaugguacaggcgauuuuuaaggaggcaggaaucaacacugacauucuccauuucaaugccgaacuggacgguaaggauuuugagaaccaggcuagcuaucaguuauggcaucugcuuuacuccuaugagggcgacgauucuaaaagcgggaaugaauugcucuacaagcugcuagagaccaaauucggauuuaagaaagaauacgcccaaauacuggcaaacgugucacucagugacgauuauggcaaucuguccacaaaggccaugcgcaagaucuacccauauauuaaagagaacaaguucagcacugcuugcgagcuugccgguuacagacacucuaaacacucauugaccaaggaagagaaugacaacaggguccugaaagauaguuuagaagugcucaagaaaaauagccugcggcagcccguuguggagaagauccuuaaccagaugaucaaucuggucaacgcauugcucaagaaauaucgcacagaaaauccuaacuuuaaguucgacgagauuagaauagagcuggcgagggaacuaaagaagaacgcugaggaacgugccaauaugaccgcaaacaucaauaaagccaagacugagcacgaaaagauuaucaaaauucugaagaacgaguuugggcucccaaauccgacgcggaacgauaucauacgauacagacuguaugaggaacuuaaagcuaauggcuacaaggacuuguacacaaacaucaaaauuccccaagagaagcuguucaccaaggaaaucgauauugagcauaucauaccuaaauccaggguguucgacgauucuuuuucgaauaagacucucagcuuccgcaaaaccaacuuagacaagggagaacggacagccuuugacuauauggaguccaaauucggcgcagauaagcuggaggaauacguagcuagaguugaggaccuuuauaagaauaacauuaucucaaaagccaaguaccagaaacugcuaaagaaagaaagugagauuggggauggauuuguggagagggaccuccgcgaaacccaguauaucgcgaagaaggccaaagagauacuguugcagaucacucgaaauguccugucuacaagcgguggcauuacggaucgguuacgugaagacugggaucucgugaacgucaugaaggagcugaaucuuccaaaauacagagcucugggguugaccgaaauggaggacaggaaguauggacaacagguggagguuaucauugauuggacuaaacgcaacgaccaccggcaccaugcaauggaugcccucacaguggcuuucaccaagcacaaccauauccaguaccugaauuaccuaaacgccaggaaaaaugaaaagcacagagagcauuccaacauaaugggcauucagcaacuggaaacaaucaagguaacugacaaaaaugguaacgagaagcgagucuuuaaagcacccaugccuaauuuccgccaggugaccaaggcguuucuugaaaacguucucaucucacacaaagccaagaauaagguggucacgaaaaacaagaauaaaguggcugggagcaacaagguacaggaggugcugaccccacggggccaguugcacaaagagacaguuuauggaaaguaccaauauuacguccagaaggaagagaaaauuggcgggaaguucgaucuggaaacuaucaaaaagguggccaaucccuuauaucagucucuccugaaaaagagacuugaggaaaacggaggugacccgaagaaagcauuuaccggcaaaaauucccuggcuaaaaacccuauuuacuuggacgaugcccaaacagagcagcuccccgagaaggugaaacuggucuggcuagaaaauaguuucagcauaaggaaggacaucacuccagagaacuuuaaagaugaaaagcugauugacaagauccuugaugaggggguuaaacguauucucaaggagcgccugcagucuuucggaaacgacgccaaaaaggcauucuccgauuuggacaaaaauccuaucugguuaaacaaggaaaagggcauaaccaucaaacgggugacgauuucagguguggcuaaugcggagccccugcauacaaagaaagaucaccucgggaaggaaauccuggacaaagagggcaagccaauucccguagauuuuaucaguaccggaagcaaccaucacgucgccguguauagagacgaaaagggcaaucuucaggagaaaguugugucggucuucgaggcagugguuagggcuaaccaagggcugccuauaauugacaagacuuacaaugaacacuugggaugggaguuucuauucacaaugaaacagaacgaaauguuuguguucccaaaugaguccaccggcuuuaacccgaaugauaucgaccugcucgaucccaagaacaaacgaaucauuucuccuaaucuguuccggguacagacuauaagcgucgugaaguacgguaacgccaucgugcgcgacuuuaaguucagacaucaccuugaaaccacagucgaggauaaaaaggaguuacaggggaaaacguaucaacagauuaagucacugaguccacucaaugacaucauuaaaguuaggaucaaccauuugggagauauaguguccguaggcgaauacuga

SEQ ID NO: 3348 - RNA, 4293 nt, Artificial Sequence
  Cas9 variant
auggcccagaaguacauccugggccucgaccuugggaccaacagcauuggaugggcuguggucaaagaggcagaaaaugauaacgagcaauccgaaauaguugacguggguguaagagugaauccccugacaacugaugagaagacgaacuucgaaaaaggcaagccuaucucuaccaaugccgacaggacauugaaacgaggggcgcgccgaaacuuacagcguuauaagcugagaaggaaggagcuaauuaaaauccucaaggagcaccagcugauuucagaugacacuauccuugcugaaaauggaaaaggcaccacauaccagacccugaaguugcgggccaaaaguagcaaggagaagauaucccucgaggaacuggcacgcgucuuucugacuaucaacaaaaagagagguuauaaaucuucgaggaagacaaagaaugaggaugaagggcaacucauugacggaauggagaucgccaagcgguuauacgaagagaaccugaccacgggccagcuuucauugcagcugcuaaaagaaggcaaaaagagccucccagauuauuaccgcagugaccuggagcuugagcuggauaaaguguggaauuuccagaagcaauuucauuccgacauuuugacugaugaguucuauacccagcucaaagggaagggacagcgagcuacaucugcacuguuuuuagaaaaauaccagaucuacacuguugaaaacaaggguaauagagaggaaaagaaccugcaagccuaucaguggaggguggacgcucucagcaaagagcuuacccgggaggaacuggccuucgucauaacagagauuaauaacaacuugaauaacuccucaggcuaccuaggggcgaucagugaccguagcaaggaacuguauuuuaauaacgagaccgugggagaauaccucuggaaacagauugcagccaauccgcacacgucucugaagaaccaaguauucuaucgccaggauuaccuugacgaguuugagagaaucuggaauacucaggcucaguucuauccccaaauccugacagaauccuugaaaaaggagcucagggauguugugauauuuuaccagcggaagcugaaaucacaaaagagcuuagucaguuucugcgaauuugagaacaaagagauugaaaucaagaaugaggacggcaccacuaccaaaaaggugauuggucugaagguggccccuaaaucuuccccacuauuccaggaguucaagaucuggcagaaccucaauaacguccugauacggaaaaaggggagcaaaacagaaaagguugcuaaaaaucaacaggugguacuuuuugaagaggagaagacgauuucggaauuggaucuggaggcaaagcaggcccucuucaacgaacugaaucuuaaaggaaaccugaaggcggacuacuguuuggagauccucggcuauucuuccaaagaaugggagaugaacuacucagugcuggagggcaaucgcaccaacaaggccuuauaugaagcauaccugaaaaucacagaucuagagggguaugacgcuaagaauuaccucaaggucaaaaguaacaaggaugaaguggagcuggacgaucuuaaaguucccgccagcgaaauuaaggagauggugcaggcuaucuuuaaagaggccggaauuaauacugacauauugcauuucgacgcagaacuggaugguaaggacuuugagaaccagggcuccuauaagcucuggcaccuguuauacucuuacgaaggggaugacagcaaaucaggaaaugagcugcuuuauaaguugcucgagaccaaauucggccugaagaaagaauacgcccagauccuagcuaacauuagucuguccgaugacuaugguaaucucagcacaaaggcgaugagaaagauccauccuuacaucaaagagaacaaguuuucuacugcaugcgaacuggccggguauaggcacucaaaacacagucuuaccaaggaggaaaaugagaaacgggucuugaaggauggccuggaggugcucaaaaagaacagcuuacgccagccaguaguugaaaagauucugaaucaaaugauaaaccuugugaaugcucuguugaaaaaguacagaacagagaaccccaacuucaaauuugacgaaaucaggauugagcucgcccgugaacugaagaaaaaugcagaggagcgggccaacaugaccgcuaauaucaacaaggccaagacugaacaugagaaaauugauaagauccuaaaauccgaguucggacugccuaauccaacgcgaaacgacauaaucagauauaggcucuacgaagaacugaaggcaaauggcuacaaagaucuuuauacaaaccgcuacauuucuucggagaaguuguuuagcaaggagaucgacauugaacacaucauaccgaaaucccgggucuucgaugacucauuuaguaauaagaccauuguguauagaacugacaaccuggauaaaggggagcagaccgcguacgacuauaucgaaucuaaguucggagcugagaaauuaaaggaguacaugacaagggucaaggaucucuaucagaaaaagauuaucagcaaagccaaguaccaaaaacugcuuaagaaggaauccgagauaggugacggcuucguggaacgcgaucugcgagagacccaguacaucgccaaaaaggcaaaagaaauucuacuccagaucacucauaauguucugucaacaagcgggggaauuacggaccgguugcguaaggauuggggccuggugaacguaaugaaagaguuaaaucuccccaaguauagagcucugggucuuaccaaaauggaggacaggaaguacgggcagcaagucgaagugaucacugauuggacaaagcgcaacgaccugcggcaccacgccauggaugcauugaccguugcuuuuacaaaacauaaucacauacaguaucucaacuaccugaacgccagaaagaaugagaaacauaaggaacacaacaauauuauggcgauccagcagcuagagacuaucaaagugaccgacgaaaacggcaaugagaagaggauuuucaaggccccuaugccaaacuuucgacaagucgcuaaaacguuccuggagaaugugcuuaucucucauaaggccaaaaacaagguagugaccaaaaauaagaacaagauuuccggaaguaauaaaguucaggaaguccucacaccccgcggccagcugcacaaggagacuguguaugggaaauaccaguauuacgugcaaaaggaagagaaaauaggagcaaaguuugauagcgaaaccaucgagaaggucgcuaacccuuuguaccagucucugcucaaaaagcgguuagaggaaaaugguggcgaccccaaaaaggccuucacagggaaaaacucccuggcaaagaauccaauuuaucuugacgauacucagaccgagcaacugccggaaaaaguuaaguugguguggcucgagaacucauuuaguaucagaaaggacauuacgccugagaauuucaaagaugaaaagcugaucgacaaaauacuagaugagggagugaagaggauccugaaagaacgucuucagagcuuuggcaacgacgcgaagaaggccuucucggaucucgagaaaaaccccauuuggcugaauaaggaaaaagguaucgcuauuaagcgcguaacaaucuccggggucgccaacgcagagccauugcacaccaaaaaggaccauuuaggcaaggagauacuggauaaagaaggaaagccuauucccguggacuuuaucucuacuggcaauaaccaccauguugcuguguaccgggaugagaaagggaaucuccaggaaaagguccugagcguguucgaggccguugugagagcaaaccagggacuuccaaucauugagaaaacauauaaucaacaccugggcugggaauuuuuguucucaaugaagcagaacgagauguucguauuucccaaugaaaguaccgguuucaacccuaaugacauagaccuacuggauccaaagaacaaaaggaucauuuccccgaaucucuuuaagguccagaaacuggccacuaagaacuacauguucacccaccaucuugagacaaaaucuaucgacggggauauguuaaagaauaaaaaggaacugagcggcauucucuauaacuuuauccagacgccccaaaaguuguacggaauaaucaaagugcgaauuaaccaccugggugacaucguguccgucggcgaguauuga

SEQ ID NO: 3349 - RNA, 4296 nt, Artificial Sequence
  Cas9 variant
augaagagaauccugggccucgaccuugggagcuccucuauuggaugggcccuggugaacgaggcugaaucaaagaaugagaggaguagcauagucaaguuggguguucgggugaaccccuuaaccguagaugaauccaucaauuucgagaaaggcaagucuauuacaacuaacgcagaccgcacgcugaaacgaucgaugcguagaaaucuacacagguacaagcuccggcgcgaagcccugaucgaggugcuuaaggagugcaaauuuauuaccgaagauacaauccugucagagaacgggaauagaacuaccuucgaaacauauagguugcgggucaaggcgcucaccgaggagauaagccuggaagaguuugcucgcgugcugaucaugauuaacaaaaagcgaggauacaaaaguuccagaaaggccggcggugcagaagaggacacucucaucgaugggauggacauugccaggaaguuauaugaugcuaaucugacaccuggagaacuuuguuugcagcugcuaucugcaggcaaaaagguucucccagacuucuaccggagcgaucugcaaaacgagcuugaccguaucugggagaaacagaaggaauauuacccgggcauacugaccgccgcuuugaaagaggaacuccgcgggaagaaaagagaugccgugugggcgauuugcgcaaaugccuuugucuggaaggagacguauacugaauggaacaaugaggaguccaagaacgaacagaucgagaaagaacauaagcuggagggaauuuacucaaaaaggaagcgggacgaagcuaaaaaggagaauuuacaguggcgagugaguggucugaaggagaaacucagccuugaacaacugguaaucaucuugcaggagauuaacacccagauaaacaauucuuccggcuaccuagggacaaucucagaucgcagcaaggaacuguauuucaacaaacagacuguuggacaauaccucauggacauucuggacaauaaccccaaugccagucuuagaaacaucguguuuuauaggcaggauuaccuggacgaguucaaugucuugugggagaagcaggcagaauuucacaaagagcucaccggcgaacugaagaaggagauacgggauauuaucaucuucuaucagcgcagauuaaaaucucaaaagggucugauuuccuuuugugaguucgagagcaggcagaucgaggugaaaauugacgggaagcguaaaauacggacagugggaaaccgagucaucccuagaucgucuccacuauuucaggaguucaagauuuggcaaauccucaauaacaucgaaguuaccgcugugggcaauaagaacaaacagaggaugcagaauggcuccaacgaacccgaugacacggagcagcuggaacuuaaugggcgccgguacuuguaucaagaggagaaggaacugcucgccaaagagcuguucguaagagauaagaugacuaaacuugacgugcugagguugcucuuugauaacccugaagaacuggacuuaaacuucaagacaauugauggaaauaaaaccgguuaccuguuuuuccaggcguacucaaagaugauagaaaugaguggccaugagccagucgacuuuaagaaacccaucgagaagauuguggaacagguuaaaagcguguucguccuacucaacuggaauacugacauccuguccuuugauucuaacaaggagcuugacaaacagagcuauuacaaguuguggcaucugcucuauucauucgaaggggauaauacaccuaccggaaacggcugccuggugcaaaagauuauggacaguuacgguuuagggaaagaguuugccaagauccuggcaaauauaacguuccaggaggauuauggcucccuuagcgcuaaagccauccacaagauuuugccacaccucaaagaaggaaaccaguacgacguagcuugugaguaugccggcuaccgccacucuaagucaagucugaccaaggaagagaucgcaaauaaaguucuaaaggauaaacuggaagugcucccgcgaaacagccugcggaaucccgucguggagaagauucuuaaccagauggucaaugugaucaacgccauaauugaggcuuacgggcguccugacgaaaucagaguugaguuggcgagggaacugaaaaagaaugcaaaggagcgcgaaaaauuaacaaaguccauugccgagacuaccaaaacacaugaggcucacaagaaacuccugcaagaagaguuuggacuuaagaacgugggucggucugauauccugagauauaaauuguacaaggaacucgagucgaggggcuauaagacucuguacagcaacaccuauauaccacgagaaaaacuauucuccaaggaguuugacaucgagcauauuaucccccaggcccgccuguucgaugacucauucaguaauaaaacacucgaagcacggaacguaaauauugagaaggggaacagaaccgccuacgauuuugucaaagaaaaguucggagagucuggcacugacaauagccuggacugcuaucuuaacaauaucgagguguuguuuguuuccgguaagauaucaaaaacgaaguacacaaaacugaagaugaccgaacaggauauuccugggggcuucaucgagagggacuuacguaacacucaguacaucgcuaaaaaggcccucagcaugcugaaugaaauuucucgcuguguggucgcaaccuccggaaguaucacagauaaacuucgggaggacuggcaacugguggauguaaugaaagaacuaaacugggagaaguauaaagcgcucggccugguggaguacuuugaagacaaggaugggaaacagauuggaagaauaaaggacuggagcaagaggaaugaucaccgacaccaugcuauggacgccuugaccguugcauucacuaaagaggucuuuauccaguauuucaacaauaagaacgccucucugaauccaaacacaaacgaauacgcuauuaaaaauaaguauuuucaaaacggucgggccaucgcacccauuccguuaaaugaguuccgcgcugaagccaaaaagcaccucgagaacacgcugaucuccauaaaggcgaaaaauaaggugaucaccaacaauauuaacaaaacuaagaaaagaggcggggugaauacaaagaaacagcagaccccuaggggacagcuucaucuggagacaaucuacggcugcugucggcaauauuugacuaaggaagagaaggucaacgccucauuugauguuaguaaaauugcuaccgugagcucguccguguaccgagacgcacuccugaagagacuacaggaacaccauaaugaucccaaaaaggccuucgcuggucgcaacucucuggacaaaaagccaguauggcuugacaaggagcagaucaggaaagucccugaaaaggugaaaacgguuaccuuugagacaauauacacuauucguaaggagaucagccccgaucuccggguggacaaaaucauugauucaggggucagaaagaugcugaccggcagguugaaggaauauggaaaugacgccaaaaaggcauucaguaaccuggaugagaaaccaauaugguuaaauaaggaaaaaggcauccccauuaagcgcgugacaaucuccgggauuucuaacgcgcagagccuccacguuaagaaagacaaggauggaaaaccugugcuggacggcaauggucgaaacaucccaguagauuucgucaacacugggaauaaccaccauguggccguguacagacggccggucauagacaagaauggacaaaugguuaucgaugagaacggcaaucuuaaauaugagcuggaagaggugguagugaccuuuuucgacgcugucacgagggugaacuugggucagcccauuaucgacaaggauuacaaagccuccgaaggcuggcaguuucucuucucaaugaagcagaaugaguauuuuguuuucccuaacaagaaaacaggguuuaauccaaaggaaauugaccugcuagaugcagacaacuacggacugaucagccccaaucuuuuccgcgugcaaaaauuuacccacaagaacuaugucuuccgucaucaccucgagacuacaauaaaagauaccaguucuauucugagaggcaucacuuggaucgacuuucgguccagcaagggguuggauucgauugugaagguuagggugaaucacaucggacagauagucucaguaggcgaguacuga

SEQ ID NO: 3350 - RNA, 4299 nt, Artificial Sequence
  Cas9 variant
augaagaaaauccugggccucgaccuugggagcaacuccauuggaugggcccuggugaaugaggcugaaaacagagaugaggcaucuucaauaaucaaguugggugucaggguuaaucccuuaaccguggacgaaaugcagaacuucgagaaaggcaagaguauuacaacuaaugccgaucggacgcugaaacgcagcaugcgacguaaccuacaaagauacaagcucaggcgggacgcgcugaucaaacuucugaaaaagguaggguuuauugcugauggaaccaucuuguccgaacagggcaaucgcucuacauucgagacuuauagacucagggccaaagcaccugacgaggaaauaucgcugcaggagcuggcccgggugcucuuaaugaucaacaagaaacgcgguuacaagucaagccgaaagauuaaagaaaaggaggcugggacccugaucgauggaaugaaagucgcaaagaaacuuuaugacgaggauuugacaccaggccagcugugccuacaacuccuggaaaguggcaagaaaucccuuccggacuuuuacucuagcgaucugcaggaggaauuugacagaauuuggaauuuucagaagcaguucaaccccaaggccuuuugugauaccgcuaaagaggaaaucaaggggaaaaauaagucccaaacuugggccauauuggcgaaauauuucauuuggacagacgagauggugguuuggaacgagaaggaaucaaagaccgagaggguggaaaaagagugcaagcucgucggacugaaacggacggugaagaaagaggaacagcguaaggagaauuaccgcuggagaguacaggcauuaacugaacagcuggaccucgguaagguugccgugguccuucaagagaucaacggccagauuaguaccagcucuggguaucugggagcuaucuccgauaggucaaaaguguuguacuuuaaucggcagacagugggccaauaccagauggccgaacuagagaagaacccuaacacuagccugcgaaauauggucuucuaucgccaggacuaccucgaugaauuugacaaaaucugggagaagcaggcagaguuccacaaagaacugaccguugagcuuaagaaggaaauuagagauauaaucauuuucuaucaaaggcggcugaaaagucagaaggguuugaucggguucugugaguucgagaaccgcgaaauaaugguggagaaaaauggaaagaugcaggcuaaaguagugggcugcaaggucauuccaagaucucauccccucuuucaggaauuuaaaaucuggcaaacacugaacaauguggagguuuuugccggcgaaaagaaguguaaaaggaagcguaccgacgcguucccuggguuauuugauggaacggaggacacucugaugguggaggguuggcgguaccuauaucaggaagagaaagaaauccucgccaaggagcuguccgucaaaaagagccuuaagaaagaauacauuuugaagcuccuguucgauaacccacaggaccuggauaugaauuuugagcagaucgagggcaacgacacagggaaugugcuuuucucggcauauucuaaaaugauugaaaaguacggauacgagccccuggacuuuggcaaauccaccgaugaaauaaucgagcgauugcaaguaauuuucacugaccucgguuggaacacagaucuguuauuuguugaccugaauaaggaagggaaggaucuagagaaacagccuuauuucaagcucuggcaucugcuuuacucauuugagggcgacaacaccccaacgggaaauggcaaauugguggaaaagcugauggagcucugccacgucgggaaagaaugugcucuggaguuagugaacaucaguuuccagaaugauuauggaagccuguccgccaaggcuaucaagaaaauucuuccguacuugaaggaggguaacagauaugacgucgccugcggcuacgcaggguauaggcacucuaaaagcucacucaccaaggaagagauagaaaacaaagugcugaaggauaaacuagacauccugcccaagaauagucuccgcaacccuguuauugagaagauccugaaucagauggugaacguaauuaaugccaucauagauacauacggaaaaccagacgaaauccgggucgagcuugcuagagaguugaagaaauccgcgaaggaaagggaugagcugacuaaagcaauugccaagagcacccgcgaacaugaggaaauccgaaagguguuacaagaggaguucggcaugauuaacguuucucggaaugacaucauacguuacaaacucuaugaggaacugaaggacaacgguuacaaaacacuuuauucaaaucaguacauucccaaggaaaaaguguuuaguaaggagaucgauauugaacacaucauaccucaggcuagacuguucgacgauagcuuguccaacaagacucucgaguauaaagccaucaauauugagaaggggaacaaaaccgcauacgacuuugucaaggaaaaauauggcgagaagggacugcaacaguaccuaaauaggugugaaucucuguucaagggccaccgcacaaaacuccggaagcugaaaauggggcaggagaacaucccagagggauuuauugauagagaccuuaggaauacccaguacaucgccaagaaggcuuuggccaugcugaacgaaauaugccgacgcgugguagcaacuacggguucgauuacagaucgguuaagagaggacuggcaacucguggauguucugaaggaacuuaaccugcccaaguaugagacccuaggccucgucgaaguguacgaggacaaagaugggaggaagaucaaacguaucaaggacuggacuaaacgcaaugaucaucggcaccaugcgauggacgcucugaccguggccuucacaaaggacgucuuuauucaguauuucaacaauaaaaacgcagccuggcaggcugauuguaaggagcacagcgacaucauuggaauaaagaccagauacuuugaaaauggcagggccuugccgccuaugccccugguucgauuccgggcagaggcuaaaucccacuuagaaacucuccuggugucaaucaaggccaaaaacaaggugguaacaaauaacgucaauugcacgaaacgcaaggguggggagaacaagaaacuucagcaaaccccaagaggccagcugcauuuggaaacuauuuauggaagucacaggcaguacgugaugaaggaggagaaaguuaaugcgucuuuugauagcuccaagaucgccacagugugcaaacaggcuuaucggaacgcacuccuggaacgacuagccgcuuucggcaaugacccuaagaaggccuuuaccgggaaaaacucacuggagaagaaucccgucuaccuugauagagaacaaacagcacgcgugccagagaggguucguacuguggaacucgagaccguauacacgauucggaaacccgucgacccuaaccugagcguggauaagguggucgacgcgaaaguuagaucuaucuuggagcagaggcugcgcgaauaugauggagaggccaagcgagcuuucgugaacuuagacgaaaauccaauauggcucaacgaggagaagggcaucgccauuaaaagaguaaccauccgggguauuaauaaggugcagucccugcaugggaaaaaggauaaaaacggaaaucuuauccuggacgaaacaggcaagaaaauaccggucgacuucgugaacacugguaauaaccaccauguugcaauuuacaggaagcccguguuggauaagaccggccaagagaugcucgacaaugaagggaacccugucuaugagcuggaugaagugguugugaguuucuucgaggcugucacacgcguaaaucuaggacugccagugaucgacaaaaacuacaauaagagcgagggcuggcaguuuauguucacuaugaaacagaacgaauauuuuguuuuccccaaugagaagaccggguuugauccuaaagaaguggaccuucucaacccagagaauuacgccgucaucucucccaaccuguuccgugugcagaagauuacggaaaaggauuauauguuuagacaccacuuggagacaaaaguaguggacgauaaguucuuaaaagagauaaccuggaagcggauccugacuccgaacaaacucgaaggaauugucaagguuagggugaaucauaucggccaaauuguguccgucggugaguacuga

SEQ ID NO: 3351 - RNA, 4299 nt, Artificial Sequence
  Cas9 variant
augaagaaaauccugggccucgaccuugggagcaacuccauuggaugggcccuggugaaugaggcugaaaacucugaugaggucucaaguauaaucaaguuggguguuagagugaaucccuuaaccguagacgaaaugcagaacuucgagaaaggcaagagcauuacaacuaaugcagauaggacgcugaaacgguccaugcgccgaaaccuacaacguuacaagcucagaagggacgcccugaucaaacuucugaaaaaggugggguuuauuaccgauggaacaaucuugucugaacagggcaaucggacuaccuucgagacauaucgccucagagcgaaagcuccugacgaggaaauaucgcugcaggagcuggccaggguccucuuaaugaucaacaagaaacgggguuacaagucaagccgcaagauuaaagaaaaggaggcagggacccugaucgauggaauggagguggccaaaaagcuguaugacgaagauuugacuccaggccagcugugccuacaacuccuggagaguggcaaaaagucccuuccggacuuuuacucuagcgaucugcaggaagaguucgaccgaauuuggaauuuucagaaacaguucaaccccaaggcuuuuugugauacagcaaaggaagagaucaaagggaagaauaaaucccaaaccugggccauauuggcuaaguauuucauuuggacggacgagaugguuguguggaacgaaaaagagucaaagacugaaagagucgagaaggaaugcaaacucgugggacugaagaggaccguaaagaaggaggagcagcggaaagaaaauuacuguuggcguguucaggccuuaacagagcagcuggaccucgaaaagguggcggucgugcuucaagagaucaacggucagauuaguacuagcucuggcuaucugggggcaaucuccgaucgcucaaagguguuguacuuuaauagacagaccgucggacaauaccagauggccgaacuagagaaaaacccuaacacaagccugaggaauaugguuuucuaucggcaggacuaccucgaugaguuugacaagaucugggaaaaacaggcugaguuccacaaggaacugaccguggagcuuaaaaaggagauucgagauauaaucauuuucuaucaacgcagacugaagagucagaaaggcuugaucgguuucugcgaauuugagaacagggaaauaaugguagagaagaaugggaaaaugcaggccaagguggucggauguaaagugauuccacggucucauccccucuuucaggaguucaagaucuggcaaacgcugaacaauguugaaguguuugcaggcgagaaaaagugcaagcgcaaaagaacugacgcuuucccuggcuuauuugaugggacagaagacacccugauggucgagggauggagguaccuauaucaggaagagaaggaaauccucgccaaagagcuguccgugaagaaaagccuuaagaaggaguacauuuugaaacuucucuucgauaacccacaggaccuggauaugaauuuugaacagaucgaggguaacgacacuggcaauguacuuuucucggcguauucuaagaugauugaaaaauacggguacgagccccuggacuuuggaaagccuacagauaaaauaaucgaacaauugcagguuauuuucgccgaccucggcuggaacaccgaucuguuauuuguggaccugaauaaggaggguaaggaucuagagaaacagccauauuucaagcucuggcaucugcuuuacuccuuugaaggggacaacacgccgaccggcaauggaaaauuggucgagaagcugauggaacucugucacgugggcaaagagugcgcacuggaguuagucaacaucucauuccagaaugauuaugggagucugagcgcuaaggccaucaagaaaauucuucccuacuugaaggaaggaaaccguuaugacguggcuugugguuacgccggcuaucggcacuccaaaucuagccucacaaaggaggaaauagagaacaaaguucugaaggauaaacuagacauccugccuaaaaauucacuccgaaacccagugguagaaaagauucugaaucaaauggucaacgugaucaaugcaauuaucgauacuuacgggaaacccgacgagauaagaguugagcuugccagggaauugaagaaaagugcuaaggagcgcgaggaacugaccaaagcgaucgcaaaguccacacgggaacaugaggagauuagaaagguguuacaggaagaguucggaaugaucaacgucagcaggaaugauauuauccgcuacaaacucuaugaggaacugaaggacaacggcuacaaaacucuuuauucuaaucaguacauaccuaaggaaaaaguguuuucaaaggagauugacaucgagcacauuaucccacaagcccgacuguucgaugacaguuugagcaacaagacccucgaauauaaagcuauaaauaucgagaaggguaacaaaacagccuacgauuuuguaaaggaaaaauauggggagaagggccugcagcaguaccuaaaucggugcgagucccuguucaagggacagcguaccaaacucagaaagcugaaaaugggccaagaaaacauucccgagggguuuaucgacagggaucuucgcaauacucaguacauugcaaagaaagccuuggcuaugcugaacgaaaucugucggagagugguugccacgacaggaucuauaaccgacagguuacgagaggauuggcagcucgucgacgugcugaaggaacuuaaccugccgaaguaugagacucuaggucucguggaggucuacgaagauaaagacggccgcaagauuaaacggaucaaggauuggaccaaaagaaaugaccacaggcaucacgcaauggaugcgcugacaguugcuuucaccaaggacguguuuauccaguauuucaacaauaaaaacgccgcauggcaagccgacugcaaggagcauucggauauuaucgggauuaagacucguuacuuugaaaauggacgcagcuugccucccaugccacuggugcgguucagagcugaggccaaaucccacuuagaaacacuccugguaucaauaaaggcaaagaacaaggucgugacgaauaacguuaauugcaccaaaaggaagggcggugagaacaagaaacuucagcagaguccucgagggcagcugcacuuggagacuaucuauggcucucaucggcaauacgugacaaaggaagagaaagucaaugcuagcuuugacuccucaaagauugccaccguguguaaacaggcguaucgcaacgcccuccuggaaagacuagcugcauucggaaaugaucccaagaaggccuuuacaggcaaaaacagccuggagaagaauccaguuuaccuuaacagggaacagacugcucgggugcccgagcgaguaagaaccgucgagcucgaaacgguguacaccauccgcaaaccuguggacccaaaccugucugucgauaagguuguggacgccaaaguaagguccauuuuggagcaacgucugcgggaauaugauggggaggcaaagagagcguucgugaauuuagacgagaacccgaucuggcucaaugaagagaagggaauagccaucaaaagggucacaauucgcggcaucaacaaggugcagagucugcacgguaaaaaggauaaaaaugggaaccuuauucuggacgaaacuggaaagaaaauccccguugauuucgugaauaccggcaacaaucaucacgucgcuauauaccgaaagccuguguugaacaagacaggucaggagaugcucgacaaugaaggcaacccaguuuaugagcuggacgagguggucgugagcuuuuucgaagccguaacuagaguuaaucuagggcugcccgugauugauaaaaacuacaauaagucugagggauggcaguuuauguucaccaugaaacaaaacgaauauuuugucuucccuaaugagaagacgcgguuugacccaaaagaaguggaucuucucaaccccgagaacuacgcaguaaucuccccgaaucuguucagggugcagaagaucacagagaaggacuauauguuucgccaucacuuggaaaccaaagucguugaugacaaguucuuaaaagagauuacuuggaagcguauacugacaccuaacaaacucgaaggcaucgugaaggugagagucaaucacauugggcagaucgugucaguuggagaguacuga

SEQ ID NO: 3352 - RNA, 4299 nt, Artificial Sequence
  Cas9 variant
augaagaacauccugggccucgaccuugggaccacaagcauuggauucgcccacauaguggaggaugaaaauaaagagaaguccgaaaucaaagagcugggugucagaauuguuucuuugacuacggacgaacagucagauuuugagaagggcaaaaguaucaccacaaacgcuaauaggacuuuaaagcauggggcacggcugaaccuagaccgcuaccaacagcgacguaaguaucucauugaucugcuucacaaagccaaucugaucacccccagcuccauauuggcggagaacggaaagaauacaacccauucuacuuggcagcucagagcuaaagccgugacagaaaggaucgagaaggaagaguucgcacggauucugcuggccaucaacaaaaagcgcggcuacaagucgucaagaaaagcuaagaccgaggacgaaggucaggcaauugaugggauggccaucgcuaaaaggcucuaugacgagaauuuaacgccuggacaacugagccuucaguugcugcagcagaacaagaaacuacucccagauuuuuaccggagugaccugcaaaaggaauuugaucuuguauggaauuuucagaaacaguucuauccggacauacugacugauauuuucuacaaggaguugcagggcaagggcaaagacgccaccuccaaggcguucucuaaacgcuaucacuuugacacagcagaaaacaaggggagcaaagaguccgugcgacuccaagccuaccaguggagagcugaggccgucucaaagcagcugaguaaggaagagguggcauacguuuuaacugaaaucaauaacaaucugaacaacgcuagcggauaucucggugccauuucugauagguccaaagagcuuuacuucaaucggcaaaccgugggccaguaucuguacgcgcaguugcaggaaaaccgucauaauucacuaaagaacaaagucuuuuaucgccaagacuaccuggaugaguucgagagaaucugggaaacacaggcccucuuucacaaggagcugaccgacgaacuuaaaaagcagaucagggaugugguaauuuucuaucagcggaagcccaaaagccaaaaggggcugauaaguuucugcgaguuugaaucuaaagagaucgagauugaaaaggacggaaaaacgaucacuaagaauauaggcgcacgaguugugccuaaguccagcccauuguuccaggaguuuaaaauuuggcagauccucaacaaugucaucuguaagcgcaaagguauuagaaagaaaaagaucucggcuaaaacaacccagcuggauuuacugaacgaaucuucccaaacuauuuucucacuagacauggagugcaagcagcuccuguuugaugagcuuaauuugaagggggaccugaaaagugauaaggugcucaaacugcuuggauacagcccccaggaaugggagauaaacuacaaucagcuggaaggcaacaggacacaaaaggccuuguaugaggcuuaccucaaaaucguggaaauggaggcccacgacgucaaggacauucugcagaucaaguccaccaaagaugacuggucuuuagaugagagcccucugucagcaagugaaauccgggaguccguuaaggccauuuuccaggcucuaggcauauguacgaaaauccucuauuuugacccacugcuucccgugaaggauuucgaggaacaagacagcuaccaguuguggcaucugcucuauucuuacgaaucagaugacaguaccagcgggaaugagacacuguaucgcauuuuagagaaaaaguacgcguuuaagagagaacacgcaaggauccuggccaacguagcccuucaggaugacuacggauccuugucuacuaaagcuauucguaagaucuauccuaauauaaaagagaaccaguacucgaccgcaugcgaaauggccgguuauaagcauagcaaacucucccugacaacugaggaacuagaggcucgggagcugaagaacaucauuccacuccugaagaaaaaugcccuucgaaacccgguggucgaaaagaucuugaaucaaaugauuaacgugguuaaugcacugaucgagaaaaacucagaaagagaugcggagggcaagauaaccaaauacuuccacuuugacgagauuaggaucgaauuagcucgcgagcucaagaaaaaugcccagaagcgguaugaaaugacacagaacauuaauaaggcaaaaagugagcaccagaagaucucugaaauacugcaaaaagaguucgggaucaagaaccccaccaaaagcgauauuaucagauacaggcuuuauaaggagcuggaacauaauggauacaaggaguuguacacuaacacguauauugccccugacgugcucuuuuccaaaaauaucgacauagaacacauugucccaaaggcucgcguguucgaugacucauucagcaacaaaacacuggccuuuaaggauuucaauaucaaaaagggcgagucuaccgcauuugacuacaucacuucccuaaagaacgaagagaaacugaaccaguaucucgcucgaguagagaaugccuacaagaccaaaaacauuagucccgcgaaguauaaaaaucugcuuaagaaggccagcgaaaucggugauggguucauuaaccgggacuugcgugauacacaguacauagcuaaaaaggcaaaagagauccuguuucagguuaccaagaauguguuaucuacuuccggcucaauuacagacagacucagggaagauuggagucuggucgacgugaugaaagagcuuaacaugccuaaguaucaaagccugggacuaacggaagucgaggagcgcaaggauggcaauaaagugaccguuaucaaggacuggacuaaacggaacgaucauagacaccaugccauggacgcucucacaguggccuucaccaagccaucguacauucaguaccugaaucacuugaacgcaaggaaagacgaaaauaacaagaauuauuccguaauccuggcgauagagaaaaaggaaacaaucaagguccccacuaacaaugggaaaaacaagcgaguguuuauugagccgaucccuaacuuccgccagguugccaaaaagcacuuagaggaaauuuuuaucucucauaaagcuaagaauaagguggucaccaaaaacacgaauaagcccgccggaaccaacaaacaacagauaacacucacuccacggggucagcugcacaaggagaccauuuacggcaaauaucaguacuaugugaauaaggaagagaagguaggggugaaauucgauaaggaaacaaucgcaaaaguuagcaacccucuuuacagagaggcucuguugaagaggcuccaagccaaugacaacgaucccaaaaaggcauuuacuggaaagaaugcccugaguaaaaacccaaucuaucuagacgaggcuaagaccaaaacgcugcccgaaaaggucaaucuuacauaccucgaggaagauuucucagugcguaaaaagauugugccuaaaaacccaaccuccaaggaguuugucccgaaucugaagucuauagaaaaaguuguggacgagggcgugcgcaacaucuugauugagcggcugagaguauacaauaacgaucccgaaaaggcguucgucgacuuagagaaaaauccuaucuggcucaacaaggaaaaagguauugccaucaagagggugacuauaagcgggguuaacaaugcacagccacugcauaucggcaaggaucaccuuggaaaaacaacccugaacaaggagggcaaagaaauucccguggacuaugucuccacugggaauaaccaccauguggcuaucuaccgagauaaggagggaaauuugcaggagcagauuguuucauucuuugaagccgugguacggacccaacagggucucccuaucauagacaaaacauauaagcaggaggaaggcuggcaguuccuguuuacgaugaagcaaaacgagauguucgucuuuccaaaugaggccaccggguucaaccccgcugaaauugaccuacuggauccgaaaaauaagaaacagaucagcccuaaccuuuuucgcgugcagaagaucgcaacuaaagacuacuucuuuagacaccaucucgagacaaauguggaaaccgauaacguccugaagaauacaacuuggaagagggagggauugaguggcuuaaaagacauuguuaaggugcggaucaaccaccugggugauauaguaucuauuggggaauauuga

SEQ ID NO: 3353 - RNA, 4302 nt, Artificial Sequence
  Cas9 variant
augaagaaaauccugggccucgaccuugggaccacaagcauuggauacgcccaggugaacgaguccgaagauuucaaggacucuucaauagagagaaucggugucaggguuaauccccugaguguggaugaacaaacuaacuuugagaaaggcaagccuauuagcaucaaugcugaccggacguugaaauccggggcacgccgaaccuuagaucguuaucaggacagaaggucuaaccugauugaugcccuaguaaagucggugaucauaacagaagacacuguccucgcggaggauggaaagaauaccacacacucaaccuucgcucugcgggccaaaagcgcaagugagaagguggaaaaagccgaguuugcucgcauccuucuggcaauuaacaagaaaagaggcuacaaguccucuaggaagacuaauaacaaugacgaugaaggucaggccaucgacgggauggcuauugccaaaaaguuguaugaugagaaccucacaccaggacagcuggcguaccaacugcucaaagagggcaagaaauauuuaccggacuucuaccggagcgaccugcaggcagaauuugauaagaucuggaccuuccagaaacaguuuuaucccgagauacuuacggacgaauugcaaaaggagcuggccggcaaggggcagcgcgcuacuuccgccauuuucuggaaaaaguacgauuuuaauaccgcagaaaacaaaggaacacgagaggagaagaaacuaaaggcuuacgaauggagaucaaccaguguugacaagaaacuccagaaggaggaaguggccuaugucaucacugagauuaauaacaaucugacaaacagcucugguuaccuuggcgcgaucuccgauaggucaaaagaacuguauuucaacaagcagaccguggggcaauacuuguuuaaacagauccagaagaauccucauacgaagcucaaaaaccaaguauucuaucggcaggacuacuuugaugaguucgagauuauaugggaaacucaggccaaguuccacccagagcugacagaagaguuaaagaauaagauccgugacauuaucauauuuuaucagcgcaaacugaaaagccaaaagggacucauuaguuucugcgaauuugagagaaaagagguugaaaucgagaagggcgguaggcggaugaaaaagaccaucgggcuuaaaguggcacccaagucuuccccucuguuccaggaauuuaaaauuuggcaggucuugaacaaugugcuaauccgaaagaagggaagcaaaaagcgcagagugaaagagccagaucagcugaaccucgucgagcaagaacaggagguuauguucuuugacaugcagacuaagcagacacuguucgaugaacuuaaugugaaaggcaaccugaaggcuaagaggauuauagaguugaucggccaagacgccaaugacugggaaauuaacuacucggagaucgaggggaaucggaccaacaaagcucucuacgaugccuaucugaagaucuuagaccuggaaggauacgauacgaaagcacuacucgacguaaagaccucuaaagaugagguggaacuggacgauauuaauauauccggucccgaggucaaggaccuugugaagcgcaucuuugaaucauuggagauugauacacagauccuggaguucgacgccgaacucgauggcgagguuuuugaaaaacagaguagcuaucugcuuuggcaucuguuguacuccuaugagggggacgauucuccuagcggaaacgaaaagcucuacaaacuguuaaagcagaaauucggcuuuaagaaggagcacgcucaaauucuggcgucaaucacucuaagugacgacuaugguucccucagcgcaaaagccaugagaaagauauacccauacaucagggagcagaccuucgauaaagcugccucucuggcaggguaucgucauucagccaguagccuuacaaaggaagagauugcuaaucggccguugaaagacaagcuggaacucaucaaaaagaacucccugcgaaaccccguggucgagaagauuuuaaaucaggugguaaacaucguuaauucucugauagaggccaacucggaaaaagauagcgacggcaauauuaucuccuacuucaaguuugaugagauuagaaucgaacuugcaagggacuugaaaaagaacgcgaaagagcgcgcugaaaugacucucaauauaaacgccgcaaagaucgugcacgagaagauuuucaaacugcuacaagccgaguuuggagucaagaauccuacccggaacgauaucauuagauauaaacuguacgaagaacucaagaauaacggcuauaaagaccuguacacaaauaucuauauaccaagggaaauucuuuucucaaagcagaucgauaucgagcacauuaucccccagaguaagauguuugacgauucuuucagcaacaaaaccauuguguuucgcaaggacaauuuggauaaagggaacuccacugcuuucgacuacauagacucacgauuuggaaaggauaaacugacggacuucgaacagcggaucgaguuuuuauucgagcaagguaagaagaacaaagaagagggcauuagcaaggccaaauaccagaagcuccugaaacgugaagcagauaucggggacggauuuauugagagagaucuuagggacacacaguauaucgcuaagaaggcccgcaaucuguuguacgaaauaugucggaucgucaccccuacuaccggcucuauuacagauagacucagggaggacugggaucuggugaacaucaugcaggagcuaaaucuggacaaauucaagaaacucggucugaccgaaaugguugagaagaaagauggguccuucaaggaacgaauuguggacuggaguaaacgcaacgaccaucggcaccaugcgauggaugcccuuacuaucgcuuuuacaaagcacagccacauacaauauuugaauuaccugaacgcaagaaagaaugagaaccauaaacagcaccauaauauuaucggcaucgagaggaaggaaacggaguucguaauugacgauuuaggaaacaaaaagcguaaauuucaccucccacugcccaauuuccgcgaagaggccaagaagcaucuugaaaacguccuggugucuuuuaaagcuaagaauaaaguugugaccaagaacaaaaauaagacugccuccucaaagggcgagaaaauaaaggucgagcuaacaccgcgggggcagcuccacaaagaaaccguguauggaaaguacaaauucuauguaaguaaggaggaaagaaucgguggcaaguuugaccagaggacaauugagcgaguggcaaacagcacucacaaacggcuguugcugcaacgcuuacucgaaaacgauaaugacgcgaagaaagccuucaccgggaagaacgcucuggccaaaaauccuaucuaccuugaugacacgaagacccugacauugcccgagauuguuaaacucacuuggcuggaggaagauuacucgaucagaaaggacauaaccccagagaacuuuaaggauaucaaagucauugacaagauccuagaugaaggagugaaaaggauucugaaggagcggcuugcaaaacauaauaacaauccuaaggaggcuuucuccgaccucgagaagaaccccaucuggcugaaugagaaaaagucuauaagcauuaaaaaggugaaaaucucaggcaucaacaaugccgaagcauugcacuauaagaagaaccaucuggguauugagaucuuagacgaugagaaaaagcgaauaccagucgacuuuguuaguacagggaauaaccaccacguggccauuuacagagaugaaaaaggcaaucuccaggaggacgugguauccuucuucgaagcugucgcgcgcgugaaccagaaucugcccaucauugauaagacucuuaaagccuaucugggauggaccuuuuuguucacgaugaagcaaaacgaguacuuuaucuucccuaacaagcagacaggcuuuaauccaaccgaaauagaccuccuggauucuaugaacaauaaacuaauuagcccgaaccuguucaggguucagaaguuuacugugaaagacuauuucuuucgucaucaccuugagacaaaugucgaagaugacuccaagcucaaaaacaccacuuggaagcgggaggggcugggaggcaucgguaauaucgugaaaguuagaauuaaccauaucgggcagauugugaagauaggagaguacuga

SEQ ID NO: 3354 - RNA, 4305 nt, Artificial Sequence
  Cas9 variant
augaagaacauccugggccucgaccuugggaccaauagcauuggaugggccuacgugaaacaggcucaaaacgauuccgagaagucugaaauagcagagcugggugucagaguuaaucccuugacaguggacgaaaagacuaacuucgagaagggcaaaccuaucucaacgaaugccgauaggaccuuaaagcgcggggcgcggcgaaaccugcagcguuauaagcuaagaaggcaggaacucauugagcugcuuaaagacuaccagguaaucagugauaagacaauucuggcugaggacggaaaagaaacuaccuuugagacauugcggcuccgcgugaaaagcgccaaagaacaagucucccuggaggagcuggcaagaauccucuuaaugauaaauaagaagaggggcuauaaaucuucgcggaaggccaaaaacgaagaugagggucagcugaucgacgggauggaaauugcucgccgacuuuacgaugagaauuugaccacuggacagcugucacuacagcuccugaaggaaggcaaaaagagccuuccagacuauuacagaagugaucugcaacacgaguuggacaaaguguggaacuuccagaagcaguuucauccggauauccucacagacgaguucuauaccuccauucagggcaaggggcaaaaagcaacgagggaaucuuuuagcuccaaguacggaaucgacacugccgagaauaaagguucacgggaagagaagaaacugcaggcuuaccaguggcgugccgaugcgacccacaaggaauuaacaaaggaggagcuggcauucguuauaacugaaauuaacaauaacaucaauaacaguagcggcuaucucggggccauuucugaccgcuccaaagagcuuaucuuugcuaacgaaaccgugggagaguaccuguggaagcaaauccagaaugauccccauacaucauugaaaaaccaggucuucuauagacaggacuacuuugaugaguucgaaaggauuugggagacccaaagcggcuuuuauccucagauacuaacggaaagucugaagaaugagcuccgggacauccugauuuucuaccagcgaaaacuuaagucucagaaggcccugguguccaucugcgaauuugagagcaaagagauaccauugaaggauaaacaagguaaccccauuucgaagaaugggaucccuguaacuaaacucguuggaccaaagguggcacccaagucuuccccucuguuccaggaguucaaaaucuggcagaacuuaaauaacguccuggugcgcccaaagggcucaagaaaaaggaaggugacaaccaaucagcaaaguacucuacucgaaggccaggaaccggucuuugagcugaaccuugaacagaaagaguugcuguucgaggaacucaaucugaaggggaaccuuaaaacagacuauugucuggaguugauuggauacagcgcuaaggaaugggagaugaauuaccccacccucgaagguaacaagacgaauaaagcccuguaugaggcguacuuaaagaucauugauuccgagggcuaugacgccaaaaagcugcuaaaaguuaagaccgauaaggacgacauaaaccucgaugacaucaaagugucugcaagcgaaauuaagacaaugaucucagauaucuuuaacgagcuggggauuaauacuaaaauacuugacuucgaugcugaauuggagcggaagcaguuugaagcccaagcuaguuaccgccuguggcaccuccuguauuccuacgagggagacgauagcaaaucuggcaacgaguuacuguauagacuuuuggaagacaaguucgguuuuaagagggagcauucaaaaacccucgccaauguaagucugcuaagcgauuacgggaaccuguccacaaaggcaauccguacuauuuacccuuauaucaaagaaaauaaguucucuaccgccugcgagcucgcuggcuaccggcacucgaaacugagcauuuccaaggaggaaaacgagaaucgaacacuuaaggacaccuuggaugugcugaaaaagaacucauuaagacagccagucguggaaaagauccucaaucagaugauaaaccugaucaaugagcuuauugaaaagcacagugagaaagacgagaagggaaacaucguuaaauauuuuaaguucgaugaaauucauaucgagcuggcgagggaauugaagaaaaaugcagaggaacgccgggagcucgacucuaaggugagagagggcaaagacaggaacgaaaagauaauuacuauccugaaaagcgaguuugggcuacccuacccuacgaagaaugauauuacacgcuaucgacuguacgaggaacucaaggacaacggauauaaagaucuguacaccaacacuuacaucccacgggaaaaacuuuucuccaaagagauagacaucgagcacauuauccccaagucacguuuguuuaaugauagcuucucuaacaaaaccauuuguuauagacaagacaaucugaacaagggugaaaggacagccuacgauuauaucgagggcuuagggaagacccagcucgacgaauaccugaaucgcgucgagaaccuuuauacuaauaaauucauaacaaaggcuaaauaccggaaccugcuaaagaaagaguccgaaauuggagauggcuuuaucgagagagaccucagggaaacgcaguauaucgccaagaaggcaaaagagaugcuguugcagauuacccgacaugugguaaguacuacagguagcaucaccgaucgccugcgggacgauugggaauuaguuaaugugaugagagagcucaaccugccgaaguacaaaguccuugggcugacagagauucaagaaaggaagaauggccagacuguggaggucauaaccgacuggacgaaacguaacgaccaccgccaccaugccauggaugcuuugaccguggccuucacaaagcacucucauauccaguaccucaauuuucugaacgcacggaaggacgaaaaacacaaggaguauuccaauauuaugggaauccagcaacuagaaacugagaaaaccacagauaaggacggcaaagauagaaggguuuucaagacuccuauucccaacuuucgacagguggcgaaagagcaucuggaaucaauccuuauaagucacaagaccaagaacaaaguagucacgcgggcuacaaauaagaucgccgggagcaaaaagcagcaggagacccucucgccacgcggacaacugcacaaagaaacuguguacgguaaguauagaagguacguucagaaggaggagaaaauuggcuccaaguucgacuugcagacaaucgaacggguggcaaacccucuguauaaacgauuacucaccaagagacuggaggaaaaugggggagaucccaaaaaggccuuuacuggcaagaacgcucuugccaaaucuccaauuuaccuggacgagacccaaacacagcaguugcccgaaaaggucaaacucguguggcuggagacggauuucagcauccgcaaggacauaaccccugauaauuuuaaagacgagaagucaauugacaagguacuagaugaagguaucaaaaggauccugaaggaccgucuuaaaaguuucgauggggacgcaaagcgggcuuuuacugaucucgagcagaacccaauuuggcugaauaaagaaaagggcauagccaucaaaagagugacaauuuccggaguuucuaacgcggagccguugcauaccaagaaggaccacuuaggcaaugaaaucuucgaugacacagggaaacccauuccugucgauuaugugagcacuggaaacaaucaucacaucgccauauacagggacgagaacggcaaucugcaagagaaggcuguguccuuuuucgaagcagucacccgcgccaaccagggucucccaacgguugauaaaacauacaaucagcaccugggguggcaguuccuuuuuaccaugaagcaaaacgagauguucguguuucccaauaaagaaacuggauucgacccucaggagaucgaucuguuggacccaaagaacaagaaacuaauuucacccaaccuguuucgagugcagaagaucagcaccaaaaauuauuucuuuagacaucaccucgaaacaaguguagagacucauaacgcucugaauggcgucaccuacaagucucagcuugguuuaaacggcauuacagacaucauaaaagugcggauuaaucaccugggggauaucguucauaucggagaguauuga

SEQ ID NO: 3355 - RNA, 4308 nt, Artificial Sequence
  Cas9 variant
augcugggcugcgagagaaagaggaaacggcgcgaaaaggagaaaauggccaagcccaaagacuacaccaucgggcucgauauuggaacaaacagcguggguugggucguuacugacgaucagaauaacauacuucgaaucaagggcaagaaagcuauuggggcacgucuguucacggaaggaaagguggccgcggagagaagguccuuucggaccacacgcagaagguugucucggcgccgauggagaaucaaaauguuagaagaacuguucgacgaggaaauugcuaagguagauccuucauuuuucgccaggcuacacgagaguuggaucagcccaaaagacaagcggaagcguuauuccgcaauaguguuuccgucucccgaagaggauaaaaaguuccaugagucguacccuacuaucuaucaccuccgcgacaaacugaugaaggaugaccaaaaacaugauauuagagaaaucuacauugccguccaccagaugaucaaggcuaggggcaauuuucuucaugacgagucaguggaaaccuaucggagcgguaugaguucccugggagggcgaucugagcgcaacauauugagcguucagacacucgaagaacugaaugaucuguucgcagagaacgaaggcaccgaggaaguggagcucaaugucgccuccgcugaacagauuaacgacaucuuaacuggcgggcaccugaaugccgacucacaaaaagagauuaguaaccuuuugcugccaagcucuuuucccuccuucgaugacaaggcgaaggagaaacaggugaagaaacuaaucaauaacguagcaacaaauaucucaaaggccuggcucggauacaaagcugauuuuagcaccauucugaaccuugccaagguugacaaggaucagaaaaagauauucgcauuugcucugcaggguggcgacgaagaggauaaagugcaagaauuggagagucuccuggaacagucucagacggacaucgucgauagauuaauugagaucaggcacgccauagugcuguccgagauugugccugucgggaugacucucagcgaagcgaugaucgacaaguaugaucagcauaaagaggaccuuaucacccugaaggccguuauucggaauacaaaggacaaaaagaaagcagcuaaguugcaagccaucuacgaucuauacgugaaaaaccgccacgcugaccuggccaaggcaaugaagcucacuggaauuaaaaagagaucggaacugcuugauccagaggagcugaaaaagggcauaucuuccuugcucgacgauucacccgaagccguagagaucaaacagaggcuggaagagaagaccuucuuaccucugcagcguaguaacaauaacggugugauuccaaaucaacuacaucaggucgaacucgacgagaucaucaaaaagcagagcaaguauuacccguuccuggcugagaaaaaccccgaugaauccgaggaagcgcagaagaaagcaccuacaaaacuugacgccuugcugaccuuucgggugccauauuacguugggcccaugauuacgaaagaggaacaagaggcucagaauggacacucuuucgccuggauggugcgaagagauccucaggaccacgaggcaauaacuccauggaacuuugaaaagaaggucgauaaaauggccagcgcuacacaguucaucaagaggaugaccacuaaagacacauaucuccugggcgaggaugugcuucccgccucaagucugaaguaccaauuguuuaccguacucaaugaacugaacaauuuacgcguuaacggcaaaaagcugacguccgacgagaaggaacaggugauugaggggcuauucaaaaagcagaaaaccgucaaggcagacaaauuugugaaguauuggcaggcgaagcauaucggagcugauauuaaagucaagggucucagcgacccgucuaaauucaauucaacaaugaguacuuacaucgauuuuaagaaaauauucggcgaccaacugaacgaugugaaucggcagaacgacuuugagaagaucauugaauacagcaccaucuucgaggauagaaaaauucuugaagacaaguugaggguugauuuugccuggcuguccgaggagcagaucaagcagcucugucgccugcgauuacaaggguggggacggcugucugacaaacuuuugacacgucucacugaugcagacggccagaaugugcuggaaagacuauggaacucgaacgauaauuucguacagauagucagcgacccuaacauuaaggccaaaaucgagcaagaaaaucagaagcugcucagggacucccagucagauaacgcuguggagaguauucuggacgaugccuauaccucuccccagaauaaaaaggcaauccgccaaguuaugcgggugguccacgacauagugaaggcuugcgaugguaacguaccagccaaauucgcgaucgaauuugccagaagccaggaggacgauccuaagaggacaaccgcucgagugaaucagaugcagaaaauuuacgaccaaaucuccgaugagguugucucacagggggugaaggaacagcuuagcggcaugaaaucuuugaaggaccgcuauuaccuguauuucaugcagggaggccgggaugcauacacuggggccaaguuaaacauugacagacucuccgacuaugauguggaccauaucaugccccaaaguuuugucaaagaugacagccuggauaauaggguucuuguggcucgugccgugaacaaucagaagucugacaaaguaccagcacuguuguucggaaacaaggucguggcggaucucgguauaacgguucgcgagaugugggacaaauggcagaagcugggcaugauuuccaagcggaaacuaucaaaucugcucacagauagugacgcccugaccgaauacagagcucaaggguuuaucaggcgacagcuuguggagacuagccaggucaucaaguugaccgccacaauucugcagucggaguuccccgauuccaaaaucauugaggugccugcaaaguacaacucuauaguucggaaacaauuugacuuauauaagagccgcgaggugaaugauuuccaccaugcuaucgacgccuaccucucaaccauuguaggaaacuaucuguaccaggucuauccaaaccuuagaaggauguuuguguacggcgaguucaagaaauuuaguuccaaugcagaggaaucugcccacgacguggcucggcgagucaagagcaugaacuuccuggaugaccuacucagagguacucacggggauaauaucuauugucgcuccacaggcgagauuguuuuuaacaggaaugacaucauaucaaaacugaagcaggcguacagcuucaaacagauguuggugacgcaagaaguauucaccaagaaaagugcccuguuuaaccagacuguguacccgucucccaagcgugauggauccaagcggagcggcuuaaucccuagaaaaagggggauggacccagagauuuauggagguuacgcacauaaucaggauucguauuucguccucgcuaagaucgagaaagugaagggcuacacacugcagauuguuggggugcccauccgcucacuugaaauaauuaacaaagccgaggacuuuucuaccgcccuguuggauaucaucaagaguaaggucauguauaaugaaaagacaggacaaccuaagcgaggcauuaaaaacguggagauacucguuaauaagcugccauacagacagcccauccuagagaaagacguguccuauaugcuggguagcucugcuuacaaguacaacauuaagcagaucacucuuagccggcaguccaugaaauauauucucgauuacaucgacgauccgaauuucaccaagcacgaaaugacgaugauagacgagcaaaacgaaagggagugccuguugucagucuaugacgaaauccuggagaaaguagauaaguacuuaccucucuuugacgggaauaaauuccgcgagaagcugcauagugcacguaaggaauuugugagccuuucuguugaugacgaggccuccgcgauugagaaaauccugagaggcuugcacgcuaacucagaaaugccaagucucgaaaaccugaagauuaaacccgcccuaggauucuuucagaugaagaauggcaucacccugagcaacgaugcagugcuucucuaucaguccccuacagggcuguucgagcggagggucaaagugucugacuuguuaaaguga

SEQ ID NO: 3356 - RNA, 4308 nt, Artificial Sequence
  Cas9 variant
augaagaacauccugggccucgaccuugggaccacaagcauuggauucgcccacauaguggaggaugaaaauaaagagaaguccgaaaucaaagagcugggugucagaauuguucccuugacuacggacgaacagucugauuuugagaagggcaaaucaaucaccacaaacgcuaauaggacuuuaaagcauggggcacggcugaaccuagaccgcuaccaacagcgacguaaguaucucauugaucugcuucagaaagccaaucugaucaccaguagcuccauauuggcggagaacggaaagaauacaacccacucuacuuggcagcucagagcuaaagccgugacagaaaggaucgagaaggaagaguucgcacggguacugcuggccauuaacaaaaagcgcggcuacaagucgucaagaaaagcuaagaccgaggacgaaggucaagcaaucgaugggauggccauugcuaaaaggcucuaugacgagaauuuaacgacuggacagcugagccuucaguugcugcagcaaaacaagaaacuacucccugauuuuuaccggagugaccugcagaaggaguucgaucuuguguggaauuuucagaaacaguucuauccagacauccugaccgauuccuuuuacaaggaauugcaaggcaagggcaaagacgccacaucuaaggcguucagcaaacgcuaucauuuugacacugcagaaaacaagggguccaaagagucaguccgacuccaggccuaccaguggagaguggaggcuauaaguaagcaacugagcaaggaagagguugccuacguguuaaccgaaauuaauaacaaucugaacaacgcaucuggauaucucggugcuaucuccgauaggucaaaagagcuuuacuucaaucggcagacagucggccaguaucuguacgcccaguugcaagaaaaccgucacaauagccuaaagaacaaaguguuuuaucgccaggacuaccuggaugaguucgagagaauuugggaaacccaggcgaguuuucauaaggagcucacggaggaacugaaaaagcagaucagggacguaguuaucuucuaucaacggaagccgaaaucucagaaggggcuuauuuccuucugcgaauuugagagcaaagagauagaaaucgagaaggauggaaaaacuauuacaaagaccaucggcgcccgagugguccccaagucgucuccucuguuccaggaauuuaaaauauggcagauuuugaauaacgugaucuguaagcgcaaagguaucagaaagaaaaagguguccgcaaaaacuacacaacucgaccuguuaaaugagucaagucagaccauuuucagccuggauauggagugcaagcagcuacucuuugaggaacugaaccuuaagggggacuugaaauccgauaagguccugaaacuccugggauacucuccacaggaaugggagaucaauuacaaccaacuugaaggcaauaggacgcagaaggcucuguaugaggccuacuugaaaauuguugagauggaagcucacgacgugaaggauauacuccagaucaagagcgccaaagacgacuggucacuggaugagagucccuuauccgcaagcgaaauucgggagucuguaaaggccaucuuccaagcucugggcaucuguaccaaaauucuauauuuugacccucuccugccagugaaggaguucgaaaaacaggauucauaccagcuuuggcacuugcuguauaguuacgagagcgacgauuccacaucugggaacgaaacucucuaucgcauacuggagaagaaguacgcguuuaaaagagaacaugucaggaucuuagcaaauguggcccugcaggacgauuacggaucgcuuagcaccaaggcuauucguaaaaucuaucccaacauuaaggagaaucaauacuccaucgccugcgaaauggcagguuauaaacacucaaaguugagucucacaacugaggagcuggaagcccgggagcuaaagaacauaaucccucugcucaaaaagaacgcucugcgaaauccaguuguggaaaagauucuuaaccagaugaucaaugucgugaacgccuugauugagaaaaauucugagagagacgcagaaggcaaaaucaccaaguacuuccauuuugaugagauaaggauugaacuggcgcgcgagcucaaaaagaacgcucagaagcgguaugaaaugacacagaauaucaacaaagccaaguuagagcaccagaaaauuagcgagauccugcaaaagcaguucgggaucaaaaauccgaccaaguccgacauaauuagauacaggcuuuaucaggaacuggagcacaacggauacaaggaauuguacacuaaugcauauaucgcccccgauguacucuuuagcaaaaacauugacaucgagcauauaguuccuaaggcucgcguguucgaugacucauucucuaauaaaacgcuggccuuucgagaguucaacauuaagaaaggcgaauccacagcauuugacuacaucaccagucuaaauagcgaggaggaacugaaccaauaucucacucgggucgaaaacgcuuacaagaccaagucuaucuccccaacaaaauauaagaaucugcuuaaaaaggccucagagauuggugaugacuucaucaaccgugauuugagagacacccaguacauugcgaaaaaggccaaggaaauacuguuucaggugacuaaaaaugucuuaaguacaagcgggucgaucacggauaggcuccgcgaggacuggggccugguggauguuaugaaggagcuuaacaugcccaaauaucaaucccugggacuaaccgaaguggaggaacggaaggacggcaauaaaguaacugucauuaagaacuggacaaagagaaaugaucacaggcaucacgcuauggacgcacucaccguggccuucacaaaaccuucuuacauccaguaccugaaccauuugaaugcucgaaaggaugagaacaauaaaaacuauagcguuauucuggccaucgaggaaaaggagacuauaaaagugcgcaccaauaacgggaagaauaaacgggucuuuaucgaaccaauucccaacuucagacagguggcaaagaagcacuuagaggaaaucuuuauuucacacaaaacgaagaacaaaguagugaccaagaauguuaacaaaccggcgggaacagacaagcagcaaaucacucucaccccuaggggucagcugcauaaggagacaauauacggcaaauaucaguacuaugucaauaaggaggagaaaauuggggugaaguucgauaaagaaacuaucgccaaggugaguaacccccuuuaccgugaagcucuguugaagcgccuccaggccaaugacaacgacccuaaaaaggcauuuaccggcaaaaaugcucuguccaagaaaccaaucuaucuagaugagucuaagacgaagacacugcccgaaaaagucaaccuuaccuaccucgaggaggacuucagcauucggaaggauauauccccagacaauuuuaaagaucugaagucaaucgaaaaaguuauugaccaaggagugaagagaaucuugauuaaaaggcugcaggccuacgauaacgaccccaagaaggcauucguggauuuagagaaaaauccuaucuggcucaacaaggaaaaagguauagccaucaagcgaguaacuauuagcggggucaauaacgcucagccacugcacaucggcaaagaccaucuuggaaagacaacccugaauaaggagggcaaagaaauuccgguggauuauguuaguacugggaacaaucaccacguggcgaucuaccgggacaaggagggaaacuugcaggagcaaauagucucuuucuuugacgccgugguucgcgcacagcagggucuccccauuaucgauaaaaccuauaagcaggcugaaggcuggcaauucauguuuacaaugaaacagaacgagauguucguguuuccuaaugaaacgaccggguucaacccagccgagaucgaccugcuagaucccaagaauaagaaacugauuuccccuaaccuuuuuagaguacagacuaucagcgucgugaaguacggaaauucgguggucagggacuucaaauuucggcaucaccucgagacaacccugcaagaugacaagauauugcagggcauuacauuccagcagaucaaaucauuagaaccacugcgaaacauuguuaaggugagaaucaaucaucucggugauauaguaucuauuggggaguauuga

SEQ ID NO: 3357 - RNA, 4308 nt, Artificial Sequence
  Cas9 variant
augaagaacauccugggccucgaccuugggaccacaagcauuggauucgcccacauaguggaggaugaaaauaaagagaaguccgaaaucaaagagcugggugucagaauuguuucuuuggcuacugacgaacagucagauuuugagaagggcaaaaguaucagcacgaacgcaaauaggaccuuaaagcauggggcccggcugaaccuagaccgcuaccaacagcgacguaaguuccucauugaucugcuucagaaagcgaaucugaucacauccgcuucuauauuggccgagaacggaaagaauacuacccacucgacauggcagcucagagcaaaagccgugaccgaaaggaucgagaaggaagaguuugcucggguacugcuggcaauuaacaaaaagcgcggcuauaaaaauucaagaaaaacuaagacagaggacgaaggucaagccaucgaugggauggcuauugccaaaugccucuacgacgagaacuuaacccccggacagcugagccuucaguugcugcagcaaaauaagaaacuacucccugauuucuauaggagugaccugcagaaggaauuugaucuuguguggaaccugcagaaacaguucuacccagacaucuugacggauuccuuuuauaaggagcuccaaggcaagggcaaagacgcgacuucuaaggcauucagcaaacgguaccauuuugacaccgccgaaaauaagggguccaaagagucaguccgccugcaggcuuaucaguggcgagccgaggcaauaaguaagcaauuaagcaaggaagagguggcuuacguucugacagaaauuaacaauaaccucaacaauucuuccggauaccuuggugccaucucagauagaagcaaagagcuguauuucaacaggcagacugugggccaguacuuguaugcgcagcuacaagaaaaucggcacaacagucugaagaauaaagucuuuuaccgucaggacuaucucgaugaguucgagcgcauuugggaaacccaggccucuuuucauaaggagcugacagacgaacuuaaaaagcagaucagagaugugguaaucuucuaccaaaggaagcugaaaucccagaagggguugguuagcuucugugaguuugaaucgaaagagauugagauagaaaaggacggaaaagcaaucaccaagucuauuggcgcucggguggucccgaaguccucaccccucuuccaggaguuuaaaaucuggcagauacugaacaaugugacgugcaagcgaaaagguauucgcaagaaaaagaguagcgccaaauccacugaauuagaucuguucaacgagccuucucaaagcaucuuuucacuagacauggaguguaagcagcuccuguucgaugaacuuaauuugaagggggaccugaaaagugauaaggugcucaaacugcuuggauauuccccacaggagugggaaaucaacuacaaucagcuggagggcaacagaacacaaaagagcuuguacgaagcauaucucaaaauuaucgagauugagggcuacgaagucaaggacauacugcagaucaagucuaccaaagacgauuggucauuagacgagaguccccugagcgccuccgaaauuagggagcggguuaaggugaucuuucagacucuagggaucugcacaaaaauucucuauuucgauccucugcuuccaguaaaggaauuugagcaacaguacucuuaucaguuguggcaucugcucuacucguaugagagcgacgauuccaccucaggaaaugaaacgcuguaccgcauauuagagaaaaaguacgcauucaagagagaacacgccaccauccuggcuaacguggcgcuucaggacgauuaugguaguuugucuacaaaagcaauuaggaagaucuaccccuauauuaaagagaaucaauacagcacugccugugaacucgcuggcuauaagcacuccaaacugucacuaaccacagaggagcuggaagcccgugagcucaagaacaucauaccucugcuuaagaaaaacgcauugcggaauccagucguggaaaagauccugaaccagaugauuaauguugugaacgccuuaaucgagaaaaauagcgagcgagacgcugaagggaagauuacuaaauacuuucacuucgaugagaucagaauagaacucgccagggagcugaagaaaaacgcacaggaacgcuaugagaugacccagaauauuaacaaggcgaaacuugagcaucaaaagaucucugaaaagcugcagaaacaguuuggaauuaagaauccgacaaaauccgacaucauacgguacagauuguaccaggagcucgaacacaacggcuauaaggagcuguacaccaauacuuauaucgcucccgauguccuauucaguaagaacauugacaucgaacacauugugccuaaagccaggguauucgaugacagcuuuucuaauaagacgcuggcauucaaagaguuuaacaucaagaaaggugaguccacagccuucgacuacauaaccucacucaauugcgaaggggagcugaaccaauaucuuacucgcguugaaaacgcuuacaagaccaagaguauuagcuugacaaaauauaagaaucuguuaaagaaggccucggagaucggcgauggauuuaucaaccgagaccuccgggauacccaguacauugcuaaaaaggcuaaggaaauccuguuccaggugacuaaaaauguccuuuccacaucuggcagcauuacggaccgucugagagaggauugggggcuaguggacgucaugaaggagcucaacaugccaaaauaccaaucacugggauugaccgaaguggaggaaaggaaggaugguaauaaaguuacugugauaaaggacuggacaaagcgcaacgaucaucggcaccaugccauggacgcgcugaccguagccuuuacaaaacccaguuauauccaguacuuaaaucaccucaacgcuagaaaggaugagaauaacaaaaauuauuccgucauucuggcaaucgagaagaaagaaacuauuaaggugccuaucaacaauggcaaaaacaagaggguuuucauagagccaauccuuaauuuucgacagguggccaagaaacaucuggaagagauuuucaucucucacaaggcuaaaaacaaggucgugaccaaaaacauuaauaagcccgccgggacggacaagcagcaaaucaccuugacaccgcgcggacagcuccacaaagaaacuauauacggcaaguaucaguacuauguaaacaaagaggagaagguggguguuaaauuugaugaacggaccauuacaaaggucagcaauccucuguacagagaggcacuacugaagaggcuucaggcgaacgacaaugaccccaaaaaggccuucgcugggaaaaacgcccucuccaagaauccaaucuaccuggaugaagcaaaaacuaagaccuugccugagaaggugaaccugacguauuuagaagaggacuuuucaauccguaaagauauuagccccgacaauuucaaggaucucaaaaguauagagaaggugaucgaccaaggcgucaaacgcauucugaucaagcggcuucaggcuuacgauaacgaccccaaaaaggccuucguugaucuggaaaagaauccaauuugguugaacaaagagaagggaaucgcaauaaaaagagugacaaucucuggcguguccaaugcccagccucuccauauugggaaggaccaccugggaaaaaccacucuaaacaaggaagguaaggagguaccagucgauuaugugagcacaggcaauaaccaucacguugcuaucuacagggacaaagaagggaaucugcaggagcaaauugugucguuuuucgaggcggucgugcgagcccagcagggacuuccgaucauagacaagaacuauaaacaggcagaaggcuggcaauuuauguucaccaugaagcagaacgagauguuuguuuuccccaaugaagcuacugguuuuaacccugccgagauugaucuccuggaccccaaaaauaagaaguugaucucaccaaacuuauuccgggugcagaccaucucuauuguaaaauacgggaauagugucgugcgcgauuuuaaguucagacaccaucuggagacaacgcuccaagacgauaaaauccugcagggcauaaccuuucagcagauuaagucccuugaaccucugaggaacaucgugaaaguccggauuaaucacuugggagacaucguuaacauaggcgaguauuga

SEQ ID NO: 3358 - RNA, 4311 nt, Artificial Sequence
  Cas9 variant
augaagagaauccugggccucgaccuugggaccaacagcauuggaugggcccuggugaaugaggcugaaaacaaagaugagagguccucuauagucaaguuggguguucgggugaaucccuuaacaguagacgaacugacuaacuucgagaaaggcaagucaaucacgaccaaugcagaucgcacacuaaaacgagggaugcguagaaaccuccagagguacaagcugcggcgcgaaacucuuaccgaggugcugaaggagcacaaauugauuacagaagacaccauccucagugagaauggaaacagaacuacauuugaaaccuauaggcugcgggccaaggcggucacggaggagauuagccuggaagaguucgcucgcgugcucuuaaugaucaauaaaaagcgaggcuacaaauccucuagaaaggccaaggguguugaagaggggacucugauagauggaauggacaucgcaagggaacuuuauaacaauaacuugaccccuggcgagcugugccuacaacuccuggaugccggcaaaaaguuucuuccagacuucuaccggucggaucugcagaaugaguuggaccguauuugggaaaaacagaaggaguauuacccggaaauccucacagaugugcugaaagaggaauuacgcgggaagaaaagagacgcugucugggcaauuugugccaaguauuuuguguggaaggagaacuacacugaguggaauaaagaaaagggaaaaaccgagcagcaagaaagggagcauaagcuggaagguaucuacucaaaacggaagcgagaugaggcuaagcgcgagaaccuccaguggagaguaaacggccuuaaagaaaagcugagcuuggagcagcuaguuauaguguuccaggaaaugaauacacaaauuaacaauaguuccggguaucugggagccaucucugacaggagcaaagagcucuacuuuaacaagcagaccgucggccaguaucagauggagaugcuggacaaaaaucccaacgcgucccuucggaauaugguguucuaccgccaagauuaucuggacgaauuuaacauguugugggagaagcaggcaguguaccacaaggaacucacggaggaacugaaaaaggagauuagagauaucaucauuuucuaucagaggcguuuaaaaucacaaaagggucugauaggguuuugcgaguucgaaagucggcagaucgaggucgacauugauggcaaaaagaagaucaaaacuguuggaaaucgagugauaagcagaucuuccccucuauuucaggaauuuaagauuuggcagauccucaacaauaucgagguaacaguggucggcaaaaagaggaaacgccggaagcugaaagaaaacuacucagcccuuuucgaggaguugaaugacgcugaacaacuggagcucaacgggagcagaaggcugugucaggaagagaaggaacuucuggcccaggaguuguuugugcgcgauaagaugaccaaaagugagguucucaagcuguuauucgacaauccacaggaacuggaucuaaacuuuaaaacuauugacggaaacaagacagguuacgcacucuuccaggcuuauucuaaaaugaucgagauguccggccaugaacccguggauuuuaagaagccugucgagaaagugguagaguacauuaaggccguuuucgaccugcuuaauuggaacaccgacauauugggguuuaauagcaacgaagaacuggauaaucaaucguauuacaaacucuggcaccuguuauauucuuucgaaggagacaacacgccaaccggcaauggucgacugauccagaagaugacagagcuuuacggguuugaaaaagaguaugcgacuauuuuggccaacguguccuuccaggaugacuacggcucacucagugcaaaggcuauccauaagauccugccccaccuaaaagagggaaaucgguacgaugucgccugcguguaugcuggcuaccgucacagcgaauccucucugaccagagaggaaauugccaacaagguccucaaagacaggcugaugcuuuugccuaagaauagccugcauaacccagugguugagaaaauauuaaaucaaauggugaacguaaucaaugucauuaucgauauuuaugggaagccggacgaaauccgcguggagcucgcacgggagcugaagaaaaacgccaaggaaagagaggaacuuacaaaaucaauagcucagacuaccaaggcgcacgaggaauacaaaacacuguugcagaccgaguuuggacucacuaacguuaguaggacggauauccugcgauauaagcuauacaaagagcuggaauccugugguuauaagacacucuacagcaauaccuacauuucucgcgagaagcuguucucaaaagaauuugacaucgagcauauuaucccccaggcacggcuuuucgaugacaguuucagcaacaagacuuuggaggccagauccgugaauauagaaaaaggcaacaauaccgcuuaugauuuugucaaggagaaauucggggaaucuggagccgacaacucgcuggagcaauacuuaaauaacauugaagaccucuuuaagagcggcaagaucuccaaaacaaaguauaauaaacugaagauggcagagcaggauauuccugacgguuucaucgagagggaucuucguaacacccaguacauagccaaaaaggcucugucaaugcuaaaugaaaucagucaccgcgugguagccacuucugggagcgugacagacaagcuccgggaggauuggcaacugauugacguuaugaaagaauugaacugggagaaguauaaagcacugggcuuagucgaauacuuugaggauagagacggaaggcagaucggccgaauuaaggauuggacgaaacggaaugaccaccgccaucacgcgauggaugcucucaccguggccuucacuaaggacguguuuauccaguauuucaacaauaagaacgcaucccuggauccaaacgccaaugagcaugcuauuaaaaacaaguacuuucagaaugggagagccauagcacccaugccucuuagggaguuccgggcugaggccaaaaagcaccuggaaaacacauugaucucaaucaaagcgaagaauaaggucauuaccggaaacaucaauaaaacacgaaagaaagguggcguuaacaagaauaugcaacagacuccaagagggcagcuccaucuggagaccauuuacggaagcggcaaacaguaucuaacgaaggaagagaaagugaacgccucuuuugacaugcgcaagauagguaccguguccaagagugcuuacagggacgcacugcuuaaacgucucuaugagaaugauaacgaccccaagaaagccuucgcugggaagaauagccuggauaaacaaccgaucugguuggacaaggaacagaugcggaagguaccugagaaagucaagauugugacacuggaagccaucuacacuauuagaaaagagaucucucccgauuuaaagguugacaaagugauagaugucggcgugaggaagauccucauugaccgccugaacgaguauggaaaugaugcaaagaaagcguuuuccaaccuugacgaaaauccaaucuggcugaacaaggagaaaggcauuucaaucaagcgaguuaccauaagugggauuagcaacgcccagucguugcacgugaaaaaggauaaggacggaaaaccuauccucgacgaaaauggcagaaacauccccguagauuucgucaauacagguaacaaucaccauguggcuguguacuaucggccagucauugacaagagggggcagcugguuguggaugaggccggaaaccccaaauacgaacuagaggagguaguggucuccuucuuugaagcagugacucgcgcuaaucugggccaaccuauaaucgacaaggauuacaaaaccacggaggguuggcaguuccuuuucucuaugaagcagaacgaauauuucguuuuuccaaaugagaaaacaggcuucaacccgaaggaaauugaccuccuggauguggagaauuacggguugaucagccccaacuuauuucguguccaaaaguucucacugaaaaauuauguguuuagacaccaucucgagaccacuauuaaggacacaaguuccauccugcggggaauaaccuggaucgauuucaggucuagcaaaggccuugacacuauuguuaaggugcgcgucaaccacaucgggcagauuguauccgugggagaauacuga

SEQ ID NO: 3359 - RNA, 4311 nt, Artificial Sequence
  Cas9 variant
augaagagaauccugggccucgaccuugggaccaacagcauuggaugggcccuggugaaugaggcugaaaacaaagaugagagguccucuauagucaaguuggguguucgggugaaucccuuaacaguagacgaacugacuaacuucgagaaaggcaagucaaucacgaccaaugcagaucgcacacuaaaacgagggaugcguagaaaccuccagagguacaagcugcggcgcgaaacucuuaccgaggugcugaaggagcacaaauugauuacagaagacaccauccucagugagaauggaaacagaacuacauuugaaaccuauaggcugcgggccaaggcggucacggaggagauuagccuggaagaguucgcucgcgugcucuuaaugaucaauaaaaagcgaggcuacaaauccucuagaaaggccaaggguguugaagaggggacucugauagauggaauggacaucgcaagggaacuuuauaacaauaacuugaccccuggcgagcugugccuacaacuccuggaugccggcaaaaaguuucuuccagacuucuaccggucggaucugcagaaugaguuggaccguauuugggaaaaacagaaggaguauuacccggaaauccucacagaugugcugaaagaggaauuacgcgggaagaaaagagacgcugucugggcaauuugugccaaguauuuuguguggaaggagaacuacacugaguggaauaaagaaaagggaaaaaccgagcagcaagaaagggagcauaagcuggaagguaucuacucaaaacggaagcgagaugaggcuaagcgcgagaaccuccaguggagaguaaacggccuuaaagaaaagcugagcuuggagcagcuaguuauaguguuccaggaaaugaauacacaaauuaacaauaguuccggguaucugggagccaucucugacaggagcaaagagcucuacuuuaacaagcagaccgucggccaguaucagauggagaugcuggacaaaaaucccaacgcgucccuucggaauaugguguucuaccgccaagauuaucuggacgaauuuaacauguugugggagaagcaggcaguguaccacaaggaacucacggaggaacugaaaaaggagauuagagauaucaucauuuucuaucagaggcguuuaaaaucacaaaagggucugauaggguuuugcgaguucgaaagucggcagaucgaggucgacauugauggcaaaaagaagaucaaaacuguuggaaaucgagugauaagcagaucuuccccucuauuucaggaguucaagauuuggcagauccucaacaauaucgagguaacaguggucggcaaaaagaggaaacgccggaagcugaaagaaaacuacucagcccuuuucgaggaguugaaugacgcugaacaacuggagcucaacgggagcagaaggcugugucaggaagagaaggaacuucuggcccaggaguuguuuauucgcgauaagaugaccaaaagugaggugcucaagcuguuauucgacaauccacaggaacuggaucuaaacuuuaaaacuaucgacggaaacaagacagguuacgcacucuuccaagcauauucuaaaaugauugagauguccggccaugaacccguugauuuuaagaagccuguggagaaagucguggaguacauaaaggccguauucgaccugcuuaauuggaacaccgacaucuugggguuuaauagcaacgaagaacuggauaaucagccauauuacaaacucuggcaccuguuauauucguucgaaggagacaacacgcccaccggcaauggucgacugauucagaagaugacagagcuuuacggguuugaaaaagaguaugcgacuaucuuggccaacguuucuuuccaggaugacuacggcucccucucagcaaaggcuauccauaagauucugccucaccuaaaagagggaaaucgguacgauguggccugcgucuaugcuggcuaccgucacagugaaagcucccugaccagagaggaaauagccaacaaggugcucaaagacaggcugaugcuuuugccaaagaauagucugcauaacccggucguggagaaaaucuuaaaucaaaugguuaacgugauuaauguaaucauugauaucuaugggaagcccgacgaaauacgcgucgagcucgcacgggagcugaagaaaaacgccaaggaaagagaggaacuuacaaaaagcaucgcucagacuaccaaggcgcacgaggaauacaaaacacuguugcagaccgaguuuggacucacuaacgugucaaggacggauauucugcgauauaagcuauacaaagagcuggaaaguugugguuauaagacacucuacuccaauaccuacaucagccgcgagaagcuguucucuaaagaauuugacauugagcauaucauaccucaggcacggcuuuucgaugacucauucaguaacaagacuuuggaggccagaagcguuaauauugaaaaaggcaacaagaccgcuuaugauuuugugaaagagaaguucggggaauccggagccgacaauucucuggagcacuacuuaaacaauaucgaagaccucuuuaagucgggcaaaauuagcaagacaaaauauaacaagcugaaaauggcagagcaagauaucccagacgguuucauagagagggaucuucguaauacccaguacaucgccaagaaggcucuguccaugcuaaacgaaauuucacaccgcgucguggccacuucugggucuguaacagacaaacuccgggaggauuggcagcugaucgacgugaugaaggaauugaauugggagaaauauaaggcacugggcuuaguugaauacuuugaggauagagacggaaggcaaauuggccgaaucaaagauuggacgaagcggaacgaccaucgccaccaugcgauggaugcucucaccgucgccuucacuaaggacguguuuauacaguauuucaauaacaaaaaugcaagccuggaucccaacgccaacgagcacgcuauuaagaauaaauacuuucagaacgggagagccaucgcaccuaugccacuuagggaguuccgggcugaagccaagaaacaucuggaaaauacauugaucuccauuaaggcgaagaacaaagugaucaccggaaauauuaacaagacacgaaagaaagguggcgucaauaaaaacaugcagcaaacucccagagggcagcuccaccuggagaccauauacggaucaggcaagcaguaucuaacgaaagaagagaagguuaaugccagcuuugacaugcgcaagaucgguaccgugucuaaauccgcuuacagggacgcacugcuuaagcgucucuaugagaacgauaaugacccgaaaaaggccuucgcugggaaaaacagucuggauaagcagccuauuugguuggacaaggaacaaaugcggaaagugcccgagaagguaaaaaucgucacacuggaagccauuuacacuaucagaaaggagauaagcccagauuuaaaaguggacaagguuaucgaugugggcgucaggaagauucucaucgaccgccugaaugaguauggaaacgaugcuaaaaaggcguuuucuaaucuugacaaaaacccuauuuggcugaauaaggaaaaaggcaucuccauaaagcgagugaccauuucagggaucaguaacgcccagagcuugcacguuaagaaagauaaggacggaaaacccauccucgacgagaacggcagaaauauuccaguggauuucguaaacacagguaauaaccaucacgucgcuguguacuaucggcccgugauagacaagagggggcagcuggucguugaugaagccggaaauccuaaauacgagcuagaagaggugguagugucguucuuugaggcagucacucgcgcuaaccugggccuuccaaucauugacaaggauuacaaaaccacggaagguuggcaguuccucuuuuccaugaagcaaaaugaguauuucguguuuccgaacgaaaagacaggcuucaaucccaaagagaucgaccuguuggauguugaaaacuacggguuaauuucuccuaaucuguuucgugugcagaaguucagccucaaaaacuaugucuuuagacaucaccuggagaccacuaucaaggacacaucaaguauacuucggggaaucaccuggauugauuucagguccucuaaaggccuggacacuaucgugaagguucgcgugaaucacauugggcagaucgucagcguaggagaguacuga

SEQ ID NO: 3360 - RNA, 4311 nt, Artificial Sequence
  Cas9 variant
augaagagaauccugggccucgaccuugggaccaacagcauuggaugggcccuggugaaugaggcugaaaacaaagaugagagguccucuauagucaaguuggguguucgggugaaucccuuaacaguagacgaacugacuaacuucgagaaaggcaagucaaucacgaccaaugcagaucgcacacuaaaacgagggaugcguagaaaccuccagagguacaagcugcggcgcgaaacucuuaccgaggugcugaaggagcacaaauugauuacagaagacaccauccucagugagaauggaaacagaacuacauuugaaaccuauaggcugcgggccaaggcggucacggaggagauuagccuggaagaguucgcucgcgugcucuuaaugaucaauaaaaagcgaggcuacaaauccucuagaaaggccaaggguguugaagaggggacucugauagauggaauggacaucgcaagggaacuuuauaacaauaacuugaccccuggcgagcugugccuacaacuccuggaugccggcaaaaaguuucuuccagacuucuaccggucggaucugcagaaugaguuggaccguauuugggaaaaacagaaggaguauuacccggaaauccucacagaugugcugaaagaggaauuacgcgggaagaaaagagacgcugucugggcaauuugugccaaguauuuuguguggaaggagaacuacacugaguggaauaaagaaaagggaaaaaccgagcagcaagaaagggagcauaagcuggaagguaucuacucaaaacggaagcgagaugaggcuaagcgcgagaaccuccaguggagaguaaacggccuuaaagaaaagcugagcuuggagcagcuaguuauaguguuccaggaaaugaauacacaaauuaacaauaguuccggguaucugggagccaucucugacaggagcaaagagcucuacuuuaacaagcagaccgucggccaguaucagauggagaugcuggacaaaaaucccaacgcgucccuucggaauaugguguucuaccgccaagauuaucuggacgaauuuaacauguugugggagaagcaggcaguguaccacaaggaacucacggaggaacugaaaaaggagauuagagauaucaucauuuucuaucagaggcguuuaaaaucacaaaagggucugauaggguuuugcgaguucgaaagucggcagaucgaggucgacauugauggcaaaaagaagaucaaaacuguuggaaaucgagugauaagcagaucuuccccucuauuucaggaguucaagauuuggcagauccucaacaauaucgagguaacaguggucggcaaaaagaggaaacgccggaagcugaaagaaaacuacucagcccuuuucgaggaguugaaugacgcugaacaacuggagcucaacgggagcagaaggcugugucaggaagagaaggaacuucuggcccaggaguuguuuauucgcgauaagaugaccaaaagugaggugcucaagcuguuauucgacaauccacaggaacuggaucuaaacuuuaaaacuaucgacggaaacaagacagguuacgcacucuuccaagcauauucuaaaaugauugagauguccggccaugaacccguugauuuuaagaagccuguggagaaagucguggaguacauaaaggccguauucgaccugcuuaauuggaacaccgacaucuugggguuuaauagcaacgaagaacuggauaaucagucguauuacaaacucuggcaccuguuauauucuuucgaaggagacaacacgccaaccggcaauggucgacugauucagaagaugacagagcuuuacggguuugaaaaagaguaugcgacuaucuuggccaacguuuccuuccaggaugacuacggcucacucagugcaaaggcuauccauaagauucugccccaccuaaaagagggaaaucgguacgauguggccugcgucuaugcuggcuaccgucacagcgaauccucucugaccagagaggaaauagccaacaaggugcucaaagacaggcugaugcuuuugccuaagaauagccugcauaacccagucguggagaaaaucuuaaaucaaaugguuaacgugauuaauguaaucauugauaucuaugggaagccggacgaaauacgcgucgagcucgcacgggagcugaagaaaaacgccaaggaaagagaggaacuuacaaaaucaaucgcucagacuaccaaggcgcacgaggaauacaaaacacuguugcagaccgaguuuggacucacuaacgugaguaggacggauauucugcgauauaagcuauacaaagagcuggaauccugugguuauaagacacucuacagcaauaccuacaucucucgcgagaagcuguucucaaaagaauuugacauugagcauaucauaccccaggcacggcuuuucgaugacaguuucagcaacaagacuuuggaggccagauccguuaauauugaaaaaggcaacaagaccgcuuaugauuuugugaaagagaaguucggggaaucuggagccgacaauucgcuggagcacuacuuaaacaauaucgaagaccucuuuaagagcggcaaaauuuccaagacaaaauauaacaagcugaaaauggcagagcaagauaucccugacgguuucauagagagggaucuucguaauacccaguacaucgccaagaaggcucugucaaugcuaaacgaaauuagucaccgcgucguggccacuucugggagcguaacagacaaacuccgggaggauuggcagcugaucgacgugaugaaggaauugaauugggagaaauauaaggcacugggcuuaguugaauacuuugaggauagagacggaaggcaaauuggccgaaucaaagauuggacgaagcggaacgaccaucgccaccaugcgauggaugcucucaccgucgccuucacuaaggacguguuuauacaguauuucaauaacaaaaaugcaucccuggauccaaacgccaacgagcacgcuauuaagaauaaauacuuucagaacgggagagccaucgcacccaugccucuuagggaguuccgggcugaagccaagaaacaucuggaaaauacauugaucucaauuaaggcgaagaacaaagugaucaccggaaauauuaacaagacacgaaagaaagguggcgucaauaaaaacaugcagcaaacuccaagagggcagcuccaccuggagaccauauacggaagcggcaagcaguaucuaacgaaagaagagaagguuaaugccucuuuugacaugcgcaagaucgguaccguguccaaacuggcuuacagggacgcacuucucaagcgucuguaugagaacgauaaugaccccaaaaaggccuucgcugggaaaaacaguuuggauaagcagccgauuuggcuggacaaggaacaaaugcggaaagugccugagaagguaaaaaucgucacauuagaagccauuuacacuaucagaaaggagauaagccccgaucucaaaguggacaagguuaucgaugugggcgucaggaagauucugaucgaccgccuuaaugaguauggaaacgaugcuaaaaaggcguuuucuaaucuggacgaaaacccaauuugguugaauaaagagaagggcaucuccauaaaacgagugaccauuucagggaucaguaacgcccagagccuccacguuaagaaggauaaagacggaaagccuauccuggacgaaaacggcagaaauauucccguggauuucguaaacacagguaauaaccaucacgucgcuguguacuaucggccagugauagacaaaagggggcagcuagucguugaugaggccggaaaucccaaguacgaacuggaggaggugguagugucguucuuugaagcagucacucgcgcuaaccuuggccagccuaucauugacaaagauuacaagaccacggaggguuggcaauuccucuuuuccaugaaacagaaugaauauuucguguuuccaaacgagaagacaggcuucaauccgaaggaaaucgaccuguuggauguugagaacuacggguuaauuucucccaaucuguuucgugugcagaaauucagccucaagaacuaugucuuuagacaucaccuggagaccacuaucaaagacacaucaaguauacuucggggaaucaccuggauugauuucagguccucuaagggccuggacacuaucgugaaaguucgcgugaaucacauugggcaaaucgucagcguaggagaauacuga

SEQ ID NO: 3361 - RNA, 4311 nt, Artificial Sequence
  Cas9 variant
augaagagaauccugggccucgaccuugggaccaacagcauuggaugggcccuggugaaugaggcugaaaacaaagaugagagguccucuauagucaaguuggguguucgggugaaucccuuaacaguagacgaacugacuaacuucgagaaaggcaagucaaucacgaccaaugcagaucgcacacuaaaacgagggaugcguagaaaccuccagagguacaagcugcggcgcgaaacucuuaccgaggugcugaaggagcacaaauugauuacagaagacaccauccucagugagaauggaaacagaacuacauuugaaaccuauaggcugcgggccaaggcggucacggaggagauuagccuggaagaguucgcucgcgugcucuuaaugaucaauaaaaagcgaggcuacaaauccucuagaaaggccaaggguguugaagaggggacucugauagauggaauggacaucgcaagggaacuuuauaacaauaacuugaccccuggcgagcugugccuacaacuccuggaugccggcaaaaaguuucuuccagacuucuaccggucggaucugcagaaugaguuggaccguauuugggaaaaacagaaggaguauuacccggaaauccucacagaugugcugaaagaggaauuacgcgggaagaaaagagacgcugucugggcaauuugugccaaguauuuuguguggaaggagacuuacaccgaguggaacaaagaaaagggaaaaacagagcagcaagaaagggagcauaagcuggaagguaucuacucaaaacggaagcgagaugaggcuaagcgcgagaaucuccaguggagaguaaacggccuuaaagaaaagcugagcuuggagcagcuaguuauaguguuccaggaaaugaacacccaaauuaauaacaguuccggguaucugggagccaucucugacaggagcaaagagcucuacuuuaauaagcagacggucggccaguaucagauggagaugcuggacaaaaaccccaaugcgucccuucggaacaugguguucuaccgccaagauuaucuggacgaauuuaauauguugugggagaagcaggcaguguaccacaaggaacucacugaggaacugaaaaaggagauuagagauaucaucauuuucuaucagaggcguuuaaaaucacaaaagggucugauaggguuuugcgaguucgaaagucggcagaucgaggucgacauugauggaaagaagaagaucaaaacaguuggcaaccgagugauaagcagaucuuccccucuauuucaggaguucaagauuuggcagauccucaauaacaucgaaguaaccguggucggcaaaaagaggaaacgccggaagcugaaagaaaauuacucagccauuuucgaggagcuuaacgacgcugaacaauuggagcugaaugggagcagaaggcucugucaggaagagaaggaacugcuugcccaggagcuguuugugcgcgauaagaugacuaaaagugagguuuugaagcuccuguucgacaacccacaggaauuagaucugaauuuuaaaacaaucgacggaaacaagaccgguuacgcacuauuccaggcuuauucuaaaaugauugagauguccggccaugaacccguggauuuuaagaagccugucgagaaagugguagaguacauaaaggccguuuucgaccuccugaacuggaauacggacauccuuggguuuaacagcaaugaagaguuggauaaccaaucguauuacaaacuguggcaccuccuguauucuuucgaaggagacaauaccccaacaggcaacggucgauuaauucagaagaugacugagcuguacggguuugaaaaagaguaugcgaccauccuugccaauguguccuuccaggaugacuacggcucauugagugcaaaggcuauccauaagauucucccccaccugaaagagggaaaccgguacgaugucgccugcguguaugcuggcuaccgucacagcgaauccucucuaacaagagaggaaauagccaauaagguccugaaagacaggcucaugcugcuuccuaagaacagcuugcauaauccagugguugagaaaauccugaaccaaauggugaauguaauuaacgucaucauugauaucuaugggaagccggacgaaauacgcguggaguuagcacgggagcucaagaaaaaugccaaggaaagagaggaacugacuaaaucaaucgcucagaccacaaaggcgaacgaggaauacaaaacccuucugcagacugaguuuggauugacgaacguuaguaggacagauauucuccgauauaagcuguacaaagagcuagaauccugugguuauaagacccuguacagcaauacuuacaucucucgcgagaaacucuucucaaaagaauuugacauugagcacaucauaccccaggcacggcuguucgaugacaguuucagcaacaagacccuugaggccagauccgugaauauugaaaaaggcaacaagacagcuuaugauuuugucaaagagaaguucggggaaucuggagccgacaauucguuggagcauuaccugaacaauaucgaagacuuauuuaagagcggcaaaauuuccaagaccaaauauaacaagcucaaaauggcaaagcaagauaucccugacgguuucauagagagggaucugcguaauacucaguacaucgccaagaaagcucuuucaaugcugaacgagauuagucaccgcgugguagccacaucugggagcgugacggacaagcuacgggaagauuggcagcucaucgacguuaugaaagagcugaauugggaaaaguauaaagcauugggccuggucgaguacuuugaagauagagacggaaggcaaauuggccgaaucaaggauuggaccaagcggaacgaccaccgccaucacgcgauggaugcuuuaacuguggccuucacaaaagacguguuuauacaguauuucaauaacaagaaugcaucccucgauccaaacgccaacgagcaugcuauuaaaaauaaguacuuucagaacgggagagccaucgcacccaugccucugagggaguuccgggcugaagccaaaaagcaccuugagaauacccugaucucaauuaaggcgaaaaacaaggucaucacaggaaauauuaacaaaacucgaaagaaagguggcguuaauaagaacaugcagcaaaccccaagagggcaguugcaucucgaaacgauauacggaagcggcaaacaguaucugaccaaggaggaacgcgugaaugccucuuuugacaugaggaagaucgagacaguguccaaaagugcuuaccgugacgcacuacugaagcggcuuuaugagaacgauaaugaccccaaaaaggccuucgcugguaaaaacagccucgauaagcagccgauuuggcuggacaaggaacagaaaagaaagguaccugagaaagucaagaucgugacuuuggaagccauuuacaccaucaggaaagagauaucucccgaucugaagguugacaaggugaucgaugucggggugcgcaaaauuuuaaucgaccgacucaaugaguauggcaacgaugcaaagaaagcguuuuccaaucuggacgaaaacccaauuuggcuuaauaaggagaaaggaaucucaauaaagagaguuacaauuaguggcaucagcaacgcccaaucgcugcacgugaagaaagauaaggacgggaaaccuaucuuggacgaaaacggacggaauauucccguagauuucgucaacacuggcaauaaccaccauguggcuguguacuauaggccagucauagacaagcgcggucagcucguuguggaugaggccgggaaucccaaauacgaacuggaggagguaguggucuccuucuuugaagcagugacccgugcuaaccuaggacagccuaucauugacaaggauuacaaaacgacagagggcuggcaauuccuguuuucuaugaagcagaaugaauauuucguuuuuccaaacgagaagaccgguuucaauccgaaagaaaucgaccuucucgauguggagaacuacggccugauuagccccaauuuguuuagaguccagaaguucucacugaaaaacuauguguuucggcaccauuuagagacuacaaucaaggacaccaguuccauacucagggggaucacuuggauugauuuccgcucuagcaaaggacuggacaccaucguuaaggugcgagucaaucacauuggccaaaucguauccgugggggaauacuga

SEQ ID NO: 3362 - RNA, 4311 nt, Artificial Sequence
  Cas9 variant
augaagagaauccugggccucgaccuugggaccaacagcauuggaugggcccuggugaaugaggcugaaaacaaagaugagagguccucuauagucaaguuggguguucgggugaaucccuuaacaguagacgaacugacuaacuucgagaaaggcaagucaaucacgaccaaugcagaucgcacacuaaaacgagggaugcguagaaaccuccagagguacaagcugcggcgcgaaacucuuaccgaggugcugaaggagcacaaauugauuacagaagacaccauccucagugagaauggaaacagaacuacauuugaaaccuauaggcugcgggccaaggcggucacggaggagauuagccuggaagaguucgcucgcgugcucuuaaugaucaauaaaaagcgaggcuacaaauccucuagaaaggccaaggguguugaagaggggacucugauagauggaauggacaucgcaagggaacuuuauaacaauaacuugaccccuggcgagcugugccuacaacuccuggaugccggcaaaaaguuucuuccagacuucuaccggucggaucugcagaaugaguuggaccguauuugggaaaaacagaaggaguauuacccggaaauccucacagaugugcugaaagaggaauuacgcgggaagaaaagagacgcugucugggcaauuugugccaaguauuuuguguggaaggagacuuacaccgaguggaacaaagaaaagggaaaaacagagcagcaagaaaaggagcauaaacuggaagguaucuacucaaagaggaagcgggaugaggcuaaacgagagaaucuccaguggcgcguaaacggccuuaaggaaaaacugagcuuggagcagcuaguuauaguguuccaggaaaugaacacccaaauuaauaacaguuccggguaucugggagccaucucugacagaagcaaggagcucuacuuuaauaaacagacggucggccaguaucagauggagaugcuggacaagaaccccaaugcgucccuuaggaacaugguguucuaccggcaagauuaucuggacgaauuuaauauguugugggagaagcaggcaguguaccacaaagaacucacugaggaacugaagaaagagauucgcgauaucaucauuuucuaucagagaagguuaaagucacaaaaaggucugauaggguuuugcgaguucgaaagucgucagaucgaggucgacauugauggaaagaagaaaaucaagacaguuggcaaccgggugauaagccgaucuuccccucuauuucaggaguucaaaauuuggcagauccucaauaacaucgagguaaccguggucggcaagaaaagaaagaggcgcaaacugaaggaaaauuacucagcccuuuucgaggaguugaacgacgcugaacaacuggagcucaaugggagccggagacugugucaggaagagaaggaacuucuggcccaggaguuguuuauuagggauaaaaugacuaagagugaggugcucaaacuguuauucgacaacccacaggaacuggaucuaaauuuuaagacaaucgacggaaacaaaaccgguuacgcacucuuccaggcuuauucuaagaugauugagauguccggccaugaacccguugauuuuaagaaaccuguggagaaggucguggaguacauaaaagccguauucgaccugcuuaacuggaauacggacaucuugggguuuaacagcaaugaagaacuggauaaccaaucguauuacaagcucuggcaccuguuauauucuuucgaaggagacaauaccccaacaggcaacggucgccugauucagaaaaugacugagcuuuacggguuugaaaaggaguaugcgaccaucuuggccaauguuuccuuccaggaugacuacggcucacucagugcaaaggcuauccauaaaauucugccccaccuaaaggagggaaaccgauacgauguggccugcgucuaugcuggcuaccggcacagcgaauccucucugacacgugaggaaauagccaauaaagugcucaaggacagacugaugcuuuugccuaaaaacagccugcauaauccagucguggagaagaucuuaaaccaaaugguuaaugugauuaacguaaucauugauaucuaugggaagccggacgaaauaagggucgagcucgcacgcgagcugaaaaagaaugccaaagaacgggaggaacuuacuaagucaaucgcucagaccacaaaagcgcacgaggaauacaagacccuguugcagacugaguuuggacucacgaacgugaguagaacagauauucugagguauaaacuauacaaggagcuggaauccugugguuauaagacccucuacagcaacacuuacaucucucgagagaaacuguucucaaaggaauuugacauugagcauaucauaccccaggcacgccuuuucgaugacaguuucagcaauaaaaccuuggaggcccgguccguuaacauugaaaagggcaauaaaacagcuuaugauuuugugaaggagaaguucggggaaucuggagccgacaacucgcuggagcacuacuuaaauaacaucgaagaccucuuuaaaagcggcaagauuuccaaaaccaaguauaauaaacugaagauggcagagcaagauaucccugacgguuucauagagagagaucuuaggaacacucaguacaucgccaagaaagcucugucaaugcuaaaugaaauuagucaccgugucguggccacaucugggagcguaacggacaagcuccgcgaggauuggcagcugaucgacgugaugaaagaauugaacugggagaaguauaaagcacugggcuuaguugaauacuuugaggaucgggacggaagacaaauuggcaggaucaaggauuggaccaagcgaaaugaccaucggcaccaugcgauggaugcucucacugucgccuucacaaaagacguguuuauacaguauuucaacaauaagaacgcaucccuggauccaaaugccaacgagcacgcuauuaaaaacaaguacuuucagaaugggcgcgccaucgcacccaugccucuuagagaguucagggcugaagccaaaaagcaucuggaaaacaccuugaucucaauuaaggcgaaaaauaaggugaucacaggaaacauuaauaaaacucggaagaaagguggcgucaacaagaauaugcagcaaaccccacgagggcagcuccaccuggagacgauauacggaagcggcaaacaguaucuaaccaaggaagagaagguuaacgccucuuuugacaugagaaaaaucgguacaguguccaagcuggcuuaccgcgacgcacuucucaaaaggcuguaugagaaugauaacgaccccaagaaagccuucgcugggaagaauaguuuggauaagcagccgauuuggcuggacaaagaacaaaugcguaaggugccugagaaaguaaagaucgucacuuuagaagccauuuacaccauccggaaagagauaagccccgaucucaagguggacaagguuaucgaugugggcgucagaaaaauucugaucgacaggcuuaacgaguauggaaaugaugcaaagaaagcguuuucuaaccuggacgaaaauccaauuugguugaacaaggagaaaggcaucuccauaaagcgcgugacaauuucagggaucaguaaugcccagagccuccacguuaagaaagauaaggacggaaaaccuauccuggacgaaaacggccgaaacauucccguggauuucguaaauacugguaacaaucaucacgucgcuguguacuauagaccagugauagacaagcgggggcagcuagucguugaugaggccggaaaccccaaauacgaacuggaggaggugguagugucguucuuugaagcagucaccagggcuaaucuuggccagccuaucauugacaaggauuacaaaacgacagaggguuggcaauuccucuuuuccaugaagcagaacgaauauuucguguuuccaaaugagaagaccggcuucaacccgaaagaaaucgaccuguuggauguugagaauuacggguuaauuucucccaaccuguuucgcgugcagaaguucagccucaaaaauuaugucuuucgucaucaccuggagacuacaaucaaggacaccucaaguauacuuagaggaaucacuuggauugauuuccgguccucuaaaggccuggacaccaucgugaagguuagggugaaccacauugggcaaaucgucagcguaggagaauacuga

SEQ ID NO: 3363 - RNA, 4311 nt, Artificial Sequence
  Cas9 variant
augaagagaauccugggccucgaccuugggaccaacagcauuggaugggcccuggugaaugaggcugaaaacaaagaugagagguccucuauagucaaguuggguguucgggugaaucccuuaacaguagacgaacugacuaacuucgagaaaggcaagucaaucacgaccaaugcagaucgcacacuaaaacgagggaugcguagaaaccuccagagguacaagcugcggcgcgaaacucuuaccgaggugcugaaggagcacaaauugauuacagaagacaccauccucagugagaauggaaacagaacuacauuugaaaccuauaggcugcgggccaaggcggucacggaggagauuagccuggaagaguucgcucgcgugcucuuaaugaucaauaaaaagcgaggcuacaaauccucuagaaaggccaaggguguugaagaggggacucugauagauggaauggacaucgcaagggaacuuuauaacaauaacuugaccccuggcgagcugugccuacaacuccuggaugccggcaaaaaguuucuuccagacuucuaccggucggaucugcagaaugaguuggaccguauuugggaaaaacagaaggaguauuacccggaaauccucacagaugugcugaaagaggaauuacgcgggaagaaaagagacgcugucugggcaauuugugccaaguauuuuguguggaaggagaacuacacugaguggaauaaagaaaagggaaaaaccgagcagcaagaaagggagcauaagcuggaagguaucuacucaaaacggaagcgagaugaggcuaagcgcgagaaccuccaguggagaguaaacggccuuaaagaaaagcugagcuuggagcagcuaguuauaguguuccaggaaaugaauacacaaauuaacaauaguuccggguaucugggagccaucucugacaggagcaaagagcucuacuuuaacaagcagaccgucggccaguaucagauggagaugcuggacaaaaaucccaacgcgucccuucggaauaugguguucuaccgccaagauuaucuggacgaauuuaacauguugugggagaagcaggcaguguaccacaaggaacucacggaggaacugaaaaaggagauuagagauaucaucauuuucuaucagaggcguuuaaaaucacaaaagggucugauaggguuuugcgaguucgaaagucggcagaucgaggucgacauugauggcaaaaagaagaucaaaacuguuggaaaucgagugauaagcagaucuuccccucuauuucaggaguucaagauuuggcagauccucaacaauaucgagguaacaguggucggcaaaaagaggaaacgccggaagcugaaagaaaacuacucagcccuuuucgaggaguugaaugacgcugaacaacuggagcucaacgggagcagaaggcugugucaggaagagaaggaacuucuggcccaggaguuguuuauucgcgauaagaugaccaaaagugaggugcucaagcuguuauucgacaauccacaggaacuggaucuaaacuuuaaaacuaucgacggaaacaagacagguuacgcacucuuccaagcauauucuaaaaugauugagauguccggccaugaacccguugauuuuaagaagccuguggagaaagucguggaguacauaaaggccguauucgaccugcuuaauuggaacaccgacaucuugggguuuaauagcaacgaagaacuggauaaucagccauauuacaaacucuggcaccuguuauauucguucgaaggagacaacacgcccaccggcaauggucgacugauucagaagaugacagagcuuuacggguuugaaaaagaguaugcgacuaucuuggccaacguuucuuuccaggaugacuacggcucccucucagcaaaggcuauccauaagauucugccucaccuaaaagagggaaaucgguacgauguggccugcgucuaugcuggcuaccgucacagugaaagcucccugaccagagaggaaauagccaacaaggugcucaaagacaggcugaugcuuuugccaaagaauagucugcauaacccggucguggagaaaaucuuaaaucaaaugguuaacgugauuaauguaaucauugauaucuaugggaagcccgacgaaauacgcgucgagcucgcacgggagcugaagaaaaacgccaaggaaagagaggaacuuacaaaaagcaucgcucagacuaccaaggcgcacgaggaauacaaaacacuguugcagaccgaguuuggacucacuaacgugucaaggacggauauucugcgauauaagcuauacaaagagcuggaaaguugugguuauaagacacucuacuccaauaccuacaucagccgcgagaagcuguucucuaaagaauuugacauugagcauaucauaccucaggcacggcuuuucgaugacucauucaguaacaagacuuuggaggccagaagcguuaauauugaaaaaggcaacaagaccgcuuaugauuuugugaaagagaaguucggggaauccggagccgacaauucucuggagcacuacuuaaacaauaucgaagaccucuuuaagucgggcaaaauuagcaagacaaaauauaacaagcugaaaauggcagagcaagauaucccagacgguuucauagagagggaucuucguaauacccaguacaucgccaagaaggcucuguccaugcuaaacgaaauuucacaccgcgucguggccacuucugggucuguaacagacaaacuccgggaggauuggcagcugaucgacgugaugaaggaauugaauugggagaaauauaaggcacugggcuuaguugaauacuuugaggauagagacggaaggcaaauuggccgaaucaaagauuggacgaagcggaacgaccaucgccaccaugcgauggaugcucucaccgucgccuucacuaaggacguguuuauacaguauuucaauaacaaaaaugcaagccuggaucccaacgccaacgagcacgcuauuaagaauaaauacuuucagaacgggagagccaucgcaccuaugccacuuagggaguuccgggcugaagccaagaaacaucuggaaaauacauugaucuccauuaaggcgaagaacaaagugaucaccggaaauauuaacaagacacgaaagaaagguggcgucaauaaaaacaugcagcaaacucccagagggcagcuccaccuggagaccauauacggaucaggcaagcaguaucuaacgaaagaagagaagguuaaugccagcuuugacaugcgcaagaucgguaccgugucuaaauccgcuuacagggacgcacugcuuaagcgucucuaugagaacgauaaugacccgaaaaaggccuucgcugggaaaaacagucuggauaagcagccuauuugguuggacaaggaacaaaugcggaaagugcccgagaagguaaaaaucgucacacuggaagccauuuacacuaucagaaaggagauaagcucugauuuaaaaguggacaagguuaucgaugugggcgucaggaagauucucaucgaccgccugaaugaguauggaaacgaugcuaaaaaggcguuuuccaaucuugacaaaaacccaauuuggcugaauaaggaaaaaggcaucucaauaaagcgagugaccauuagugggaucagcaacgcccagucguugcacguuaagaaagauaaggacggaaaaccuauccucgacgagaacggcagaaauauucccguggauuucguaaacacagguaauaaccaucacgucgcuguguacuaucggccagugauagacaagagggggcagcuggucguugaugaagccggaaaucccaaauacgagcuagaagaggugguaguguccuucuuugaggcagucacucgcgcuaaccugggccuuccuaucauugacaaggauuacaaaaccacggaagguuggcaguuccucuuuucuaugaagcaaaaugaguauuucguguuuccaaacgaaaagacaggcuucaauccgaaagagaucgaccuguuggauguugaaaacuacggguuaauuagccccaaucuguuucgugugcagaaguucucacucaaaaacuaugucuuuagacaucaccuggagaccacuaucaaggacacaaguuccauacuucggggaaucaccuggauugauuucaggucuagcaaaggccuggacacuaucgugaagguucgcgugaaucacauugggcagaucgucuccguaggagaguacuga

SEQ ID NO: 3364 - RNA, 4311 nt, Artificial Sequence
  Cas9 variant
augaagagaauccugggccucgaccuugggaccaacagcauuggaugggcccuggugaaugaggcugaaaacaaagaugagagguccucuauagucaaguuggguguucgggugaaucccuuaacaguagacgaacugacuaacuucgagaaaggcaagucaaucacgaccaaugcagaucgcacacuaaaacgagggaugcguagaaaccuccagagguacaagcugcggcgcgaaacucuuaccgaggugcugaaggagcacaaauugauuacagaagacaccauccucagugagaauggaaacagaacuacauuugaaaccuauaggcugcgggccaaggcggucacggaggagauuagccuggaagaguucgcucgcgugcucuuaaugaucaauaaaaagcgaggcuacaaauccucuagaaaggccaaggguguugaagaggggacucugauagauggaauggacaucgcaagggaacuuuauaacaauaacuugaccccuggcgagcugugccuacaacuccuggaugccggcaaaaaguuucuuccagacuucuaccggucggaucugcagaaugaguuggaccguauuugggaaaaacagaaggaguauuacccggaaauccucacagaugugcugaaagaggaauuacgcgggaagaaaagagacgcugucugggcaauuugugccaaguauuuuguguggaaggagaacuacacugaguggaauaaagaaaagggaaaaaccgagcagcaagaaagggagcauaagcuggaagguaucuacucaaaacggaagcgagaugaggcuaagcgcgagaaccuccaguggagaguaaacggccuuaaagaaaagcugagcuuggagcagcuaguuauaguguuccaggaaaugaauacacaaauuaacaauaguuccggguaucugggagccaucucugacaggagcaaagagcucuacuuuaacaagcagaccgucggccagugccagauggagaugcuggacaaaaaucccaacgcgucccuucggaauaugguguucuaucgccaagauuaccuggacgaauuuaacauguugugggagaagcaggcaguguaucacaaggaacucacggaggaacugaaaaaggagauuagagauaucaucauuuucuaccagaggcguuuaaaaucacaaaagggucugauaggguuuugugaguucgaaagucggcagaucgaggucgacauugauggcaaaaagaagaucaaaacuguuggaaaucgagugauaagcagaucuuccccucuauuucaggaguucaagauuuggcagauccucaacaauaucgagguaacaguggucggcaaaaagaggaaacgccggaagcugaaagaaaacuauucagcccuuuucgaggaguugaaugacgcugaacaacuggagcucaacgggagcagaaggcugugccaggaagagaaggaacuucuggcccaggaguuguuuauucgcgauaagaugaccaaaagugaggugcucaagcuguuauucgacaauccacaggaacuggaucuaaacuuuaaaacuaucgacggaaacaagacagguuacgcacucuuccaagcauacucuaaaaugauugagauguccggccaugaacccguugauuuuaagaagccuguggagaaagucguggaguauauaaaggccguauucgaccugcuuaauuggaacaccgacaucuugggguuuaauagcaacgaagaacuggauaaucagccauacuauaaacucuggcaccuguuauacucguucgaaggagacaacacgcccaccggcaauggucgacugauucagaagaugacagagcuuuauggguuugaaaaagaguacgcgacuaucuuggccaacguuucuuuccaggaugacuauggcucccucucagcaaaggcuauccauaagauucugccucaccuaaaagagggaaaucgguacgauguggccugugucuacgcuggcuaucgucacagugaaagcucccugaccagagaggaaauagccaacaaggugcucaaagacaggcugaugcuuuugccaaagaauagucugcauaacccggucguggagaaaaucuuaaaucaaaugguuaacgugauuaauguaaucauugauaucuacgggaagcccgacgaaauacgcgucgagcucgcacgggagcugaagaaaaacgccaaggaaagagaggaacuuacaaaaagcaucgcucagacuaccaaggcgcacgaggaauauaaaacacuguugcagaccgaguuuggacucacuaacgugucaaggacggauauucugcgauacaagcuauauaaagagcuggaaaguugcgguuacaagacacucuauuccaauaccuacaucagccgcgagaagcuguucucuaaagaauuugacauugagcauaucauaccucaggcacggcuuuucgaugacucauucaguaacaagacuuuggaggccagaagcguuaauauugaaaaaggcaacaagaccgcuuacgauuuugugaaagagaaguucggggaauccggagccgacaauucucuggagcacuauuuaaacaauaucgaagaccucuuuaagucgggcaaaauuagcaagacaaaauacaacaagcugaaaauggcagagcaagauaucccagacgguuucauagagagggaucuucguaauacccaguauaucgccaagaaggcucuguccaugcuaaacgaaauuucacaccgcgucguggccacuucugggucuguaacagacaaacuccgggaggauuggcagcugaucgacgugaugaaggaauugaauugggagaaauacaaggcacugggcuuaguugaauauuuugaggauagagacggaaggcaaauuggccgaaucaaagauuggacgaagcggaacgaccaucgccaccaugcgauggaugcucucaccgucgccuucacuaaggacguguuuauacaguacuucaauaacaaaaaugcaagccuggaucccaacgccaacgagcacgcuauuaagaauaaauauuuucagaacgggagagccaucgcaccuaugccacuuagggaguuccgggcugaagccaagaaacaucuggaaaauacauugaucuccauuaaggcgaagaacaaagugaucaccggaaauauuaacaagacacgaaagaaagguggcgucaauaaaaacaugcagcaaacucccagagggcagcuccaccuggagaccauauacggaucaggcaagcaguaccuaacgaaagaagagaagguuaaugccagcuuugacaugcgcaagaucgguaccgugucuaaauccgcuuauagggacgcacugcuuaagcgucucuacgagaacgauaaugacccgaaaaaggccuucgcugggaaaaacagucuggauaagcagccuauuugguuggacaaggaacaaaugcggaaagugcccgagaagguaaaaaucgucacacuggaagccauuuauacuaucagaaaggagauaagcccagauuuaaaaguggacaagguuaucgaugugggcgucaggaagauucucaucgaccgccugaaugaguacggaaacgaugcuaaaaaggcguuuucuaaucuugacaaaaacccuauuuggcugaauaaggaaaaaggcaucuccauaaagcgagugaccauuucagggaucaguaacgcccagagcuugcacguuaagaaagauaaggacggaaaacccauccucgacgagaacggcagaaauauuccaguggauuucguaaacacagguaauaaccaucacgucgcuguguauuaccggcccgugauagacaagagggggcagcuggucguugaugaagccggaaauccuaaauaugagcuagaagaggugguagugucguucuuugaggcagucacucgcgcuaaccugggccuuccaaucauugacaaggauuacaaaaccacggaagguuggcaguuccucuuuuccaugaagcaaaaugaguacuucguguuuccgaacgaaaagacaggcuucaaucccaaagagaucgaccuguuggauguugaaaacuauggguuaauuucuccuaaucuguuucgugugcagaaguucagccucaaaaacuacgucuuuagacaucaccuggagaccacuaucaaggacacaucaaguauacuucggggaaucaccuggauugauuucagguccucuaaaggccuggacacuaucgugaagguucgcgugaaucacauugggcagaucgucagcguaggagaguauuga

SEQ ID NO: 3365 - RNA, 4311 nt, Artificial Sequence
  Cas9 variant
augaagagaauccugggccucgaccuugggaccaacagcauuggaugggcccuggugaaugaggcugaaaacaaagaugagagguccucuauagucaaguuggguguucgggugaaucccuuaacaguagacgaacugacuaacuucgagaaaggcaagucaaucacgaccaaugcagaucgcacacuaaaacgagggaugcguagaaaccuccagagguacaagcugcggcgcgaaacucuuaccgaggugcugaaggagcacaaauugauuacagaagacaccauccucagugagaauggaaacagaacuacauuugaaaccuauaggcugcgggccaaggcggucacggaggagauuagccuggaagaguucgcucgcgugcucuuaaugaucaauaaaaagcgaggcuacaaauccucuagaaaggccaaggguguugaagaggggacucugauagauggaauggacaucgcaagggaacuuuauaacaauaacuugaccccuggcgagcugugccuacaacuccuggaugccggcaaaaaguuucuuccagacuucuaccggucggaucugcagaaugaguuggaccguauuugggaaaaacagaaggaguauuacccggaaauccucacagaugugcugaaagaggaauuacgcgggaagaaaagagacgcugucugggcaauuugugccaaguauuuuguguggaaggagacuuacaccgaguggaacaaagaaaagggaaaaacagagcagcaagaaagggagcauaagcuggaagguaucuacucaaaacggaagcgagaugaggcuaagcgcgagaaucuccaguggagaguaaacggccuuaaagaaaagcugagcuuggagcagcuaguuauaguguuccaggaaaugaacacccaaauuaauaacaguuccggguaucugggagccaucucugacaggagcaaagagcucuacuuuaauaagcagacggucggccaguaucagauggagaugcuggacaaaaaccccaaugcgucccuucggaacaugguguucuaccgccaagauuaucuggacgaauuuaauauguugugggagaagcaggcaguguaccacaaggaacucacugaggaacugaaaaaggagauuagagauaucaucauuuucuaucagaggcguuuaaaaucacaaaagggucugauaggguuuugcgaguucgaaagucggcagaucgaggucgacauugauggcaaaaagaagaucaaaacaguuggaaaccgagugauaagcagaucuuccccucuauuucaggaauuuaagauuuggcagauccucaauaacaucgagguaaccguggucggcaaaaagaggaaacgccggaagcugaaagaaaauuacucagccauuuucgaggagcuuaacgacgcugaacaauuggagcugaaugggagcagaaggcucugucaggaagagaaggaacugcuugcccaggagcuguuugugcgcgauaagaugacuaaaagugagguuuugaagcuccuguucgacaacccacaggaauuagaucugaauuuuaaaacaaucgacggaaacaagaccgguuacgcacuauuccaagcauauucuaaaaugauugagauguccggccaugaacccguggauuuuaagaagccugucgagaaagugguagaguacauaaaggccguuuucgaccuccugaacuggaauacggacauccuuggguuuaacagcaaugaagaguuggauaaccagucguauuacaaacuguggcaccuccuguauucuuucgaaggagacaauaccccaacaggcaacggucgauuaauucagaagaugacugagcuguacggguuugaaaaagaguaugcgaccauccuugccaauguguccuuccaggaugacuacggcucauugagugcaaaggcuauccauaagauucucccccaccugaaagagggaaaccgguacgaugucgccugcguguaugcuggcuaccgucacagcgaauccucucuaacaagagaggaaauagccaauaagguccugaaagacaggcucaugcugcuuccuaagaacagcuugcauaauccagugguugagaaaauccugaaccaaauggugaauguaauuaacgucaucauugauaucuaugggaagccggacgaaauacgcguggaguuagcacgggagcucaagaaaaaugccaaggaaagagaggaacugacuaaaucaaucgcucagaccacaaaggcgaacgaggaauacaaaacccuucugcagacugaguuuggauugacgaacguuaguaggacagauauucuccgauauaagcuguacaaagagcuagaauccugugguuauaagacccuguacagcaauacuuacaucucucgcgagaaacucuucucaaaagaauuugacauugagcacaucauaccccaggcacggcuguucgaugacaguuucagcaacaagacccuugaggccagauccgugaauauugaaaaaggcaacaagacagcuuaugauuuugucaaagagaaguucggggaaucuggagccgacaauucguuggagcauuaccugaacaauaucgaagacuuauuuaagagcggcaaaauuuccaagaccaaauauaacaagcucaaaauggcagagcaagauaucccugacgguuucauagagagggaucugcguaauacucaguacaucgccaagaaggcucuuucaaugcugaacgaaauuagucaccgcgugguagccacaucugggagcgugacggacaaacuacgggaggauuggcagcucaucgacguuaugaaggaacugaauugggagaaauauaaggcauugggccuggucgaauacuuugaggauagagacggaaggcaaauuggccgaaucaaagauuggaccaagcggaacgaccaccgccaucacgcgauggaugcuuuaacuguggccuucacaaaggacguguuuauacaguauuucaauaacaaaaaugcaucccucgauccaaacgccaacgagcaugcuauuaagaauaaauacuuucagaacgggagagccaucgcacccaugccucugagggaguuccgggcugaagccaagaaacaccuugaaaauacccugaucucaauuaaggcgaagaacaaagucaucacaggaaauauuaacaagacucgaaagaaggguggcguuaauaaaaacaugcagcaaaccccaagagggcaguugcaucucgagacgauauacggaagcggcaagcaguaucugaccaaagaagagaaggugaaugccucuuuugacaugcgcaagaucgagacaguguccaaaagugcuuacagggacgcacuacugaagcgucuuuaugaaaacgauaaugaccccaaaaaggccuucgcugguaaaaacagccucgauaagcagccgauuuggcuggacaaggagcaaaugcggaaaguaccugaaaaggucaaaaucgugacuuuggaggccauuuacaccaucagaaaggagauaucucccgaucugaaaguugacaaggugaucgaugucggggugaggaagauuuuaaucgaccgccucaaugaauauggcaacgaugcuaaaaaggcguuuuccaaucuggacaaaaacccaauuuggcuuaauaaggagaaaggaaucucaauaaagcgaguuacaauuaguggcaucagcaacgcccagucgcugcacgugaagaaagauaaggacgggaaaccuaucuuggacgaaaacggaagaaauauucccguagauuucgucaacacuggcaauaaccaccauguggcuguguacuaucggccagucauagacaagaggggucagcucguuguggaugaggccgggaaucccaaauacgaacuggaggagguaguggucuccuucuuugaagcagugacccgcgcuaaccuaggacugccuaucauugacaaggauuacaaaacgacagagggcuggcaguuccuuuucucuaugaagcaaaaugaauauuucguuuuuccaaacgagaagaucgguuucaauccgaaagaaauugaccuccuggauguggagaacuacggcuugaucagccccaauuuauuucguguccagaaguucucacugaaaaacuauguguuuagacaccaucucgagaccacuauaaaggacacaaguuccauccugcgggggauuaccuggaucgauuucaggucuagcaaaggacuugacacuauuguuaaggugcgcgucaaucacaucggccagauaguauccgugggggaauacuga

SEQ ID NO: 3366 - RNA, 4311 nt, Artificial Sequence
  Cas9 variant
augaagagaauccugggccucgaccuugggaccaacagcauuggaugggcccugguggaugaggcugaaaauaaagacgagagguccucuauagucaaguuggguguucgggugaaccccuuaacaguagaugaacugacuaauuucgagaaaggcaagucaaucacgaccaacgcagaccgcacacuaaaacgagggaugcguagaaaucuccagagguacaagcugcggcgcgaaacucuuauggaggugcugaaggagcacaaauugauuaccgaagauacaauccucagugagaacggaaauagaaccacuuuugaaacauauaggcugcgggccaaggcggcuaccgagaaaauuagccuggaggaguucgcccgcguccucuuaaugaucaacaagaaacgaggcuacaaguccugcagaaaggcaaaaggugccgaagaagggacgcugauagacggaauggauaucgcuagggagcuuuauaauaacaauuugacuccuggcgaacugugucuacaacuccuggacgcaggcaagaaauaccuuccagauuuuuaucggucugaccugcagaacgaguuggaucguauuugggagaagcagaaagaauacuauccggagauccucaccgaagugcugaaggaggaauuacgcgggaaaaagagagacgccguuugggcuauuugcgccaagucguucgugugggaggaguacuacacagaauggaauaaagagaagggaaaaacugaacagcaagagagggaacauaagcuggaggguaucuauucaaaacggaagcgagaugaggcgaagcgcgaaaaccuccaguggagagucaauggccuuaaagagaagcugagcuuggaacagcuagugauaguacugcaggagaugaacauucaaaucaacaauaguuccggguaccucggagcaauuucugacaggagcaaagagcuguauuuuaacaagcagaccguuggccaguaccagauggaaaugcuugacaaaaaucccaacgccucccugcggaauaugguguucuaucgccaagauuacuuggacgaguuuaacacacucugggaaaagcaggcugaguaucacaaggaacugaccggugagcucaaaaaggagaucagagauaucgucauuuucuaccagaggcgucugaaaucacaaaaggggcuagugggauuuugugaguucgaaagucggcagauagaaguggagaucgacggcaaaaagaagauuaaaacggucggcaaucgaguuaucccuagaagcucuccacucuuucaggaguucaagauauggcagauucugaacaauaucgaagugacuguaguggggaaaaagggaaaaaggcgcaagcaaaaagauaacucccccacacuuuuugacgguuuggaugacaccgagcagcuggaacucaauggcucacgguaccuguaucaggaggaaaaggagcuucuggcccaggaauuguucgucagagauaagaugacuaaaagcgacgugcucaagcuguuauucgauaacccucaagagcuggaccuaaauuuuaaaacaaucgacgggaacaagaccggauacacguuauuccaggcauauaguaaaaugauugagaugucuggccaugaaccaguugauuuuaagaagaccguggagaaagucguggaacacguaaaggcuguuuucgaccugcuuaauuggaacacagauaucuuggguuuuaacuccaaugaggagcuggacaaccagagcuacuauaaacucuggcaucuguuauacucguucgaaggggauaauacucccaccggcaacgccaggcuggugcagaagauuacagagcuuuauggauuugaaaaagaguacgcgauaaucuuggccaaugucacuuuccaagacgauuacggcucucucuccgcaaaggcuauucacaagauccugccucaccuaaaagaagggaaccgcuaugacguggccugcgcuuacgccggauauaagcauucagagaguagccugaccaaagaggaaaucgcaaauaaggcccucaaagaucgacugacacuuuugccaaagaacaaucugcggaacccggucguggagaagauuuuaaaucagaugguuaacgugauaaaugcuaucauugacaccuacgguaaacccgaugaaauccguguagagcucgcgagagaacugaagaaaaacgcaaaggagagggaggaacuuacuaaauuuauugccgagacgacacgcaagcacgaagaguucaaaauccuguugcaguccgaauuuggccucaccaaugucucucggacugacauacugagauauaagcuauacaaggagcuggagagcuguggguauaaaacccucuacucaaacacauacaucccuagggaaaagcuguucaguaaagaguuugauauugaacauaucauuccacaggcucgacuuuucgacgacuccuucagcaacaagaccuuggaggcccgcucuaucaaucuggagaaaggaaacaagacugcauaugauuuugugaaggaaaaauucggcgagucaggugccgacaauaguuuagaucacuaccucaacaauauagaagaccuguuuaagagcgggaaaauuuccaagacaaaauauaacaaacuuaagauggcugagcaagauauccccgacggcuucauuaaucgggaucugagaaacacgcaguacaucgccaaaaaggcacuaucuaugcucaaugaaauaucgaggcguguuguggcgaccagcggaacuaucacagacaaacugcgccaggauuggcaauuggucgacgugaugaaggagcugaacugggagaaauauaaggcuuuaggccucguagaauacuuugaggauaaggacgggcggcagauuggaagaaucaaagauuggaccaagaggaaugaccaccgacaucacgccauggacgcacugacaguggccuucacuaaagauauuuuuauccaguauuucaacaauaagaacgcuucccuuaauucaaacaccaacgaauacgccauaaagaauaaguacuuucagaacggucgggcaauugcuccuaucccacugcgcgaguucagaguugaagccaagaaacauuuggagaauacgcucaucaguauuaaggcgaaaaacaaggucgugaccggcaauaucaacaaaacaaagaaaaggggaggggugaauaaguaucugcaacagacuccccggggccagcuacaccuggagaccauuuacgguucugggaagcaguaucuuacaaaagaagagaaggucaacgccagcuuugacaugaaaaagauagcuacuguuuccaaaucagcauaccgagaugugcuccugaagagauugcaugaaaaugacaacgauccgaagaaagccuucaccggcaagaauagccuggacaaacaaccuaucugguuagauaaggagcagacgcgcaaagugcccgaaaagguaaagacagucacccucgagacuauuuauacagugaggaaagagaucucuccagaccugaagguugauaaagugauugacgcuggaguccguaagauccuuaccggccggcugaacgaauacgggaaugaugccaaaaaggcauuuuccaacuuggacgagaauccuauauggcucaacaaggaaaaaggaaucaguauuaagagagugacuaucagcggcauuucuaaugcgcagucccugcacguuaaaaaggacaaagaugguaagcccauccuagacgaggauucaaggaacauaccaguggacuucguaaacaccgggaauaaccaccaugucgccguguaucgccgacccgugauugauaaaagaggacagcuggucaucgacgaggcuggcaauccuaaguacgaacuugaggaaguugugguaaguuucuuugaggccgugacacgggcaaaccucggucaaccaaucauugauaaggacuacaaaacgagcgaaggcuggcaguuccuguuuucgaugaagcagaaugaguauuucgucuuuccgaacgagaaaaccggguucaaucccaaggaaauagauuuguuagacgcugagaacuacggagugaucuccccuaaucuguuuaggguucaaaaauucgcccacaagaacuauguguuucgccaucaccucgaaacuacaauuaaggauaccucuagcauccugaaaggcauuacauggaucgacuuccguucaaguaaggggcuugaugcaauagucaaagugagaguuaaucacaucggacagauuguguccgucggcgaguacuga

SEQ ID NO: 3367 - RNA, 4311 nt, Artificial Sequence
  Cas9 variant
augaaguacaucaaauauauucugggccucgacauagggagcaacuccaucggaugggcccuuauucagcuggauuuguuacaaaagaccaaaagaaucauugcugcagguucuaggaucauacccauggaccagaaggugcugucagauuucggcaaagggaucacaauuaguccuacugcccagcggacgagcuaccgcaaugcgcgacacugccgugagagacaucuacucaggcgggaacgccugcacagaguccuucauauccugggauuuuugccaacccacuaugacaagcagauugauuucuccaagagguacggcaaauuuguugacaacacagagccgaagaucgcuuauaaugaagguaaauuccucuuuauggauucuuuccaagagaugcugucggacuuuaagucacaucagcccgaucuguucuacacuaaaaagaacggggaagagagcaagauaccuuaugacuggaccauuuacuaccuccggaaaaaggccuuaagucagaaaaucuccaaggaggaacuggcauggauuauccuuaauuuuaaccagaaacgcggauauuaccaauugcgagaggaagagggcaauaaggagaacgauuucgaaaucauuucuagcaaaauaaucuccgugauuaagaaggacaaagauaagaaauauaauaaguacugguaugacaucauacuggagaacggccuaguauaccaggccgcuuuuuauaaugacuucguguacaacuggauuaaucaggauagagaauuuaucaucgagaggacaucacucaaaaacggggcagaaaaggucaagcugaguuaccuuccaaccuucgacgagauugauaaaauggacaagaaagagcaggauaaguauuacaaaaagaucaagauuaaaacugaaaauagcauaggaaacaagacaguggguuguuauaucuacgaccacauucugcaaaaccccaaugagaaaaucaagggcaaauugguucggaccaucgaacguaaguauuacaaggaggaacucaaagccauucuggagaagcagauagcuuuacagccugagcuguucacggaucaacuccuugccgacugcauccgcgaacuguauucuaaaaacgaggcgcagcagagaaauuuggcagccagggauuuugugcaccuacuggucgaagacauuaucuucuaccagcggccacuccgacgccaaaaguccacucuggcuaacuguucacuugagagcagaaguuacauugauaaagacucucauaccaggaaggaagcaccccugaaagugugcccuaaguccaauccauauuaccaggaguuucggguauugcaguggcuccagaaccugaagaucuaugagauagacagcgaucaagaaguuacacaccaguucaucaaaacuuuagaggacaagcagcagcuguuugaauuucuaauggcccaaaaagagauugauugugaggaacuccugaaguacuuucuuaaucagaccuauccgaacgcuaaagagaaggccuugaagucggaacugaaaaaguggaaagacacauaccgcuggaauuauguguacgauaucggggagaagucuuccaaaaaguaccccaugaacgaaaccagauaugagcucaagaggcaucuggagaaagucgcgaaucuuccugacgauuuccugucaagugaaguggaguacuugcucuggcaccugauuuauagcgugaaggacaaagucgccuacgaaaagggauuaaagaaguuugcacagaagcaccaucuggauaaagacuccuucguugagucuuuuaagaaauucaacccauaucccagcgaauacggcucauuuagugagaaggcuauccguaaacuacucccucugaugcgguucggugcccacugggauuucaaucauauagacaagaacacgcagaaacgaauugaggaucuuaucacugggguggaaaaugaggaaauuagaacaaucuugagggagaaggcugaaaaguaucaacuggagaaagagaccgacuuucaggaccucccacugugguuagcccaguacauaguauacaaccgccacgcagaagccuccagccuggagaaguggacuucugugaacgaucuugaaacauauuugaaugaguucaaacaacauucacuccggaaccccaucgucgaacaggugguuauggaaacccugagaguggucagggacauuuggcagcaguacggacaaggccaggcuaguuucuucaaugagauccacauugaacuaggccgcgagcugaagaaaacggcgaaggaacgagagaagcucagcaaacagaaccagaagaaugaggauaucaaccuguccauaaaagaaaaacuuaaagaguuggaaaaguauaauacccgggcauacucuauuacacaccaagagaaguauaaacugugguuagaacagaagcauaucucgccguacacugggcagaucauuagcccugagaaccucuuuaccgacaauuaugagaucgaacacauuauaccccagucccguuucuuugaugacucacugaguaacaaagugguaugcgagucuaucguuaauaaggccccauacaaagauagacaacuuggacuggaguucauuaagaaccaggguggcaggaucgugaaggaguugagcaaagaaaauaagacaauuaaaaucuuuacugaggagcaguaccgcaccuucauaaaggaacauuauuccaacaauccugagaaaacaaagaagcuccugcuagaagagauccccgagaaaauggucgcucggcaaaugaacgacaccuguuacauuucaaaguuuaucagcgaaauucugucuaaaaucgugagauccgaugagcaggacgaagggguccacaguaagaacgugauacucugcacuggaaaaauuacgagcauccugaggcaggauuggggccuuaaugacaucugggauaacuugauucugccacgauucgagcgcaugaauaacuuacuccagaaggaaaaauuuacaauauauucuaucgagaagcaaaagaaaauucccguugugccuaucaaugaccaguucaaguccuuccagaaaaagcggauugaccacagacaucacgccauggaugcaaucauaaucgccuguaccacuagggagcauauuaacuacaucaauaaccagcacgcucuggaaaaagagaaggacaagaaagaaaagcaagaggaacgugauaaacuucgcgagaagcugugcauuaaaaaguauaauaaccggucagaggguaauuacaguuggaucuuuaagaaaccaugggacaccuucacacaggaaguaagagucgcccuagaggauauagugguuagcuuuaagcagaaccucagggugauuaauaaagcaaccaacuauuacgaacgaugggucgaggaaaaugggaaguacaucaaaaagauggugaagcaggagggcacuaacugggcgauccggaaaccgcugcaugaggaaacaauuucgggaaagaucuauuuggaccgcgagaaaauaacgaagaacgauauucugaccgcuacuagaaaaacaguagacuccucuuucgaugacaagaggaucaaaaagauuaccgauacaggcauccaaaagauauuacucaauuaccugaaauauaaggggagccccgaaauugccuuuucaccugagggacuugaggaacugaacaaaaauuugaguaucuacaacgacgguaagccacacaaacccaucuauaaggugcggauuuacgagaagggcuccgggcgauucgcacucggagaaaaaggcagaaaguauaaaaaguacguucagggugccucuaaucuguacuuugggaucuaucagggcgcuaaacgcagcuucgccacuauuccucuaaacgaggucauagaaaggcagaagcaaggacugccauccgugcccgaguacaaugagaagggcgaccuucuccuguuuucauugagcccgaacgaucugguguaugucccuaucgaaggggagauuaucgaaaauaucgacuuccguaacuuaaguaaagagcagaaggaacggauuuacaauguuaacgauuuuucuuccaccuguuauuucacgccaaauagaauagcaaaagcuaucuuccccaaggagguggaccuccagaggaaaggagauaagcugagcgguucguacgacaccaagacagccucacuugagggcauucaaaucaaagaagugugcauuaagcugaaaguagaucgcuuggggaacaucucuaaggcguga

SEQ ID NO: 3368 - RNA, 4314 nt, Artificial Sequence
  Cas9 variant
augaaguacaucaaauauauucugggccucgacauagggagcaacuccaucggaugggcccuuauucagcuggauuuguuacaaaagaccaaaagaaucauugcuacagguucuaggaucauacccauggaccagaaggugcugucagauuucggcaaagggaucacuauuaguccuacggcacagcggaccagcuaccgcaaugcccgacacugccgugagagacaucuacucaggcgggaacgccugcacagaguccuucauauccugggauuuuugccaacacacuaugacaagcagauugauuucuccaagagguacggcaaauuuguugacaacacugagccgaagaucgcguauaaugaacggaaauuccucuuuauggauucuuuccaagagaugcuggcugacuuuaagauacaucagcccgaucuguucuacaccaaaaagaacggugaagagucgaagauuccuuaugacuggacaaucuacuaccuccgcaaaaaggccuuaucacgaaaaauuagcaaggaggaacuggcauggaucauccuuaauuuuaaccagaaaagaggguauuaccaguugagggaggaagaggaggaaaauaaggagaacgauuucgaaauuauaaguuccaaaaucauuucugugaucaagaaggacaaagauaagaaauauaauaaguacugguaugacauaauucuggagaacgggcuaguauaccaagccgcuuuuuauaaugacuucguguacaacuggaucaaucaggaucgggaauuuaucauugagcguaucagccucaaaaacggcaccgagaaggucaagcuguccuaccuuccaacuuucgacgaaauugauaaaauggacaagaaagagcaggauaaguauuacaaaaagauaaagaucaaaacagaaaauucaauuggcaacaagaccgugggguguuauaucuacgaccacauccugcagaaccccaaugagaaaauuaagggaaaauugguucgcacgauagaaagaaaguauuacaaggaggagcucaaagcaauccuggaaaagcaaguggccuuacagccugagcuguucacugaucagcucuuugcugacugcauuagggaacuuuauaguaaaaacgaggcccaacagcggaaucuggcggcacgagauuucguccacuuguuuguggaagacaucauuuucuaccagcgcagccuaagaaggcagaagucuacccuggccaacuguucccucgagucacggagcuacaucgauaaagacagucauacacgcaaggaggcuccacugaaaguaugccccaagucuaauccuuauuaccaagaauuuagaguucuucaguggcugcagaacuugaagauauaugagaucgacacugaucaggaagugacccacgaguucauuaaaacacucgaggacaagcaacaguuuuucgauuuucugaugaaucagaaagaaaucgacugugaggaauuacugaaguacuuccuaaaccagaccuauccaaaugccagggagaaagcacucaaguccgaacugaagaaauggaaggauacguaccguuggaacuaugucuacgacauuggugagaaaagcucgaagaaauacccgaugaaugagacucgguaugaacuuaagcgacauuuggagaagguggcuaaccugcccgaugacuuucucucuuccgaaguggaguaccugcuuuggcaccugaucuauucagucaaagauaagguugccuacgaaaaaggcuugaagacauucgcgcaaaaacaccaucucgacaaggauaguuuuguggagagcuucaagaaauucaagccuuauccauccgaguacgggucuuuuagcgaaaaagccauaagaaagcuguuaccccugaugagguucggaucauauugggacuuuaaucacauugauaaaaacacccagaagcgcaucgaggaccuaauuacuggcguagaaaaugaggaaauccggacaauacucagagagaaagcagagaaguaccagcuggaaaaggagaccgacuuccaggaucuuccuuuguggcuggcucaauacaucguguauaacaggcaugccgaagcuaguucccucgagaaauggacgagcgucaacgaccuggagaccuacuuaaaugaauuuaagcaguauucucugcgcaacccaauuguggagcagguugugauggaaacacuucgagucgugcgggauaucuggcaacaguacggucaggggcaggccucauucuuugacgagauucacaucgaauugggacgugagcucaaaaagacugcaaaagagagagaaaagcugaguaagcaaaaucagaaaaacgaggauauaaaucuaagcauuaaggaaaaacugaaggagcucgaaaaauauaacaccagggccuacuccaucacacaucaggagaaguauaagcuguggcuugagcagaaacacaucucucccuacacuggccaaauuaucucgccggaaaauuuguucaccgacaacuacgagauugaacacauaaucccucagagccgcuuuuucgaugacucccugucaaauaagguaguuugcgagaguauugugaacaaagcucccuauaaggaucggcaguuaggccucgaauuuaucaaaaaucaagggggaagaauugucaaggagcugucuacagagaacaagaccaucaaaauauucacugaagaacaguacaggacguuuaucaaggaacauuauagcaauaacccagagaaaacaaagaaacuucuguuggaggaaauuccugagaagaugguggcgcgacagaugaaugacaccuguuacaucuccaaguucauuucagaaauccucagcaaaauaguccgcucugaugagcaggacgaaggugugcacuccaagaacguuauucugugcacuggcaaaaucaccagugcacuaaagcaagauuggggagugaacgacguauggaaugaccugauccucccccgguucgagagaaugaacgaucugacacagagcacccuuuuuacuacauauaaugagaaauaccagaaguauuugccaacgguccccauggaauacucuaacggauuccagaaaaagaggauugaccaucgucaccacgccauggaugcuauaaucauugccugugcaacccgcgagcauaucaauuacauuaacaaucaacacgcccuggaaaagggcaaagacaagaaagagaagcagaaagaacaugauaaguuacgggagaagcucugcaucaaaaaggacaacaaagguuccgaggaaaauuauucauggauauuuaagaaaccuugggauacuuucacacaggaggugcaggcugcccuggaagggaucguugugaguuuuaagcaaaaccuuagagucauuaauaaggcaaccaacuacuaugagagguggguggaagagaauggcaaauacaucaagaaaaugguaaagcaggagggaacaaacugggcgauucgaaaaccacugcacgaagagacuaucagcggcaagauauaucuagaccgggaagagauuaccaagaaugauauccucacggcuacccgcaaaacaguggacucguccuucgaugagaagagaaucaaaaagauuacugacaccgggauccagaaaauacuguugaacuaccugaaguauaaaggaucuccggaaauugccuuuagccccgaggguuuagaggagcucaacaagaaucugucaaucuacaacgacggcaagccucauaaaccaauuuacaagguuaggaucuaugaaaaagggaguggacgguucgcacuuggcgagaagggucgaaaauacaagaaguauguccagggggcccccaaucuguacuuuggcauauaucaaggagcuaacaaaagauccuucgccacaauuccuuugaaugaggugaucgaacgccagaagcagggcaggccaucuauccccgaguacaacgaaaaaggggauccgcuccuguuuagccuauccccuaaugaccugguguaugucccaguugagggagaaauuaucgaggauauugacuuccagaaccuuucaaaggagcaaaaagaacguauauacaaugugaacgauuucagcaguacuuguuacuuuacccccaaucggaucgcaaaggcuauuuucccuaaggagguggaccuccagagaaaaggugauaagcugcccggcucuuaugacacgaaaacagccuccuuggaagggauccagaucaaggagguaugcauuaaacugaagauagauagguuaggaaacaucagcaaggcguga

SEQ ID NO: 3369 - RNA, 4317 nt, Artificial Sequence
  Cas9 variant
augaagaccauccugggccucgaccuugggacaaacagcauuggaugggcccugauaaaacagaauuucgagaacaaguacggugaaaucuugggcaugggguccagaauuauccccaugucucaagauauuuuaggagaguuuggcaaagguaauucagugagucagacugcugcaaggacggacuaucgggccacccgccgacugcgugaaagauuccuacucaggcgggagcgccugcacagaguccuuaacguucugaauuucuugccugaacauuacgcgagccagaucgauuucgacaagagguuugggaaauucaagguggagacagagccaaagcucgcuuggaaaaacauagauggaaaguuuuccuuccuguuucagacuucuuucaaugaaaugcuggaggacuuuaaagcccacggccaagaucucaagguaccguaugacuggaccaucuacuauuuacggaaaaaggcacugucgcagaagauugaaaaagaggagcuuguguggaucuugcugaacuucaaucagaagcgcggcuacuaucagcuacgaggggaagaggaagaggaaaaccccaauaaacucauugaguuuuacucacugaagaucauagauguccuugccgacgagccucaaaaaggaaagagcgauauuugguacagucugguguuggaaaacgguuggaucuauagaagguccucuaaaacaagccuccuggacuggaaggauaagauucgggacuucaucguuaccacugacuuaaaugaugacggcuccgugaaaacagauaaggaggggaacgaaaaacguucauuccgcgcuccaggagagaaugacuggacccuggucaagacgaaaacugaacaggagaucgauagaaguaggaagaccgugggcaacuacauuuaugagacacuccuucagaaccccaagcagaaaauaaaggguaaacugguacggacuaucgaacgaaaguuuuacaaagaggaauugaagcgcauucuagagaagcaaaaagaauuucauagagagcuggagagcaaugaccucuauaacgauugcaucagggaacuguaccggaauaacgaggcacaccagcuuacccugucuaagaaagacuuuguucauuuguucauggaagauauaauuuucuaucagcgcccucucaagucccaaaaaucaagcaucaguaauuguacacuggaguucagaaaguacaaggacgagaacgggaucgaacacacccaguuuuuaaaagccauuccaaagucuaaucccuacuaucaggaguucaggaucuggcaguggauuuuuaaccugaauauauacaaaaaggauaacgacgacaaugugacgaaagaauuucuaaacacuacacgugauuuugagaaucucuucgaauuucugaacaaucggaaggagaucgagcaaaaaccucuuuugaaguuccugcucgaacagaaggaguucaaaggaaagcugcuuaacgcugaaaccgagaaauuucgauggaacuaugucgaagacaagaaauacccaugcaaugagacuagaacaaugauuuccgagaggcugaagaagguggaaaacaucagcgaugacuucuugacccgcgagauggaacagaaaaucuggcacauuauauauucggugaaugauaagacggaguacgaaaaagcccucaagucuuuugcggagaaaaacaaucuggacgagaacuccuuauucgaagcauuuaagaagcugccgcccuucaaaucagaguauggcaguuuuagcgaaaaggccaucaaaaagcuacucccucugaugcggcuuggcaaauacugguccuacgcuaagauugauuuguauucuaagaauagaauccagaaaauuaucaccggggaguucgacgagaacauaaaggauaggguccgcgaaaaagccauccgacugacagcagagaaugacuuucaaggacuccagcugugguuagcucaguacauuguuuauggucggcauagcgaagccucaaugaucggcaaguggaacagugcggaugaccuggaggaguuccuuaaagaauuuaagcagcacuccuugcguaauccaauuguggagcaaguaaucacugaaacccucagaauagugaaagauauuuggcugaaguacgggaacggagccaaggacuucuuuaaugagauccauauugaacuaggcagggagaugaaacagacaaaggacgaacgcgcaaacgcuacuaaaaccaucacagagaaugagaacaccaaccugcggauaaaggcccuccuggcugaaaugaugaaugaucacagcgucgagaacgugagacccuauucuccuaugcagcaggaaauccuuaaaauuuacgaggacgguaucuugaagucagauauugaaaucgacgaugacauacugaagauuaguaaaacugcccaaccaagcuccucugauuuaaagagguauaaacucuggcuggagcagaaguacaaaucgcccuacacggggcagaucaucccgcuuaauaagcuguucacaccugaguaugaaauugagcacaucauuccccaaagccgauacuucgacgauuccuuuucaaacaagauaaucugugaaagugcaguuaauaaauugaaggacaacuauauuggccucggauucaucaaacaguuuggcgggaccauuaucgagugcggauucgguaagcgcgugaaagucuuugaggugggcgaauacgaggaguucguaaagaagcauuaugccaauaaccgggggaaaagaaauaagcugcuacuggaagaaauaccagagaaaaugaucgagaggcagaugaacgauacucgucacauuucuaaguacaucagcggcauucucucccauaucguucgcguggaagacggaaccgaugagggugucaauagcaaaaacgugauaccugggaauggcaagauuacaacccagcugcggcaagacuggggacuuaacgacgucuggaaugaauugauccugcccagauuugagaggaugaaccaguuaacuaacucaacagauuucacgucuuggaaugaaaaccaccagaaguaucucccaaccgugcccguugaguuuuccaaaggcuucaguaagaaacgaaucgaccaucggcaccacgcucuggaugcgcuugugauugcaugugccacuaaggaccauguaaaucugcuaaacaaucagagcgcuaaaucugccacaaagcgcuacgaucucaaaaagaagcugaugaaauuugagaagaccgucuacaaagacccucaaacagaaaagagaauagagagggaagugccaaaacacuucuugaagccgugggagacuuucaccguugaugcaaagaaccggcuggaaacgaucauuguguccuuuaaacagaauuuacgagucaucaacaaggccaccaauuauuacgagaaauauguggagaaggacgggguaaugaugaaagaaagaguggagcagacaggaacuaacugggcuauucgcaagcccaugcauaaggaaaccguuucagguaaaaucgaucucccuugggucaaggugccaaaaggcaagauacugacagccacuaggaaaagucuugacaccagcuucgaucugaaggcaaucgcgucgauuacggacacagggauccagaagauuuugaaaaauuaccucgaguuuaaggagucccccgaacuggcuuucucuccugagggaaucgaagacaugaacaaaaauauagagaaguauaacggcggucguccacaccaacccauuagcaaagugcgggucuuugaacuagggucaaaguuccagguuggccagaccggaaauaaaaaggauaaguacguggaggccgcaaaaggcacuaaccuguuuuucgccaucuaugaggacaagaaagggaagagaaguuacgaaacaaucccgcuuaaugaggugauugaaaggcaaaaacagggacucuccguagucgaucugaagaacgugaacgacuuuuucuugugcccuaaugaucugguuuacaucccaucuggcgacgaguuugaaaaccgcgguagcauagagauugagaauaucaccaaggaaaaauccgagcgauucuauaagguggucucauuuagcgggagucagauuuucuucgugagacacgauaucgcuguuucuauagugaacaaaggagaauuuuccacuuuaaauaagauggagcgggccauugacggcagcaugguaaaagaaaucuguaucaagcucaagauugauaggcugggugacguccuuaaagcauga

SEQ ID NO: 3370 - RNA, 4317 nt, Artificial Sequence
  Cas9 variant
auggugaagaaaggcuacaccaucgggcuggacauuggaacaacuagcgucgguugggccguuacggaugacgauuucgagcucgugaacaagaaaauguccauaaaggacaaaucuggcucaaccaucaagagaguaaggaagaaucuuuggggagugcggcuguuugaugaagcuaaaacagcagagaacacucgccgaacccguggggucagaaggcggauucgcagaaggaaggaacgguugaauuauuuacagggcaucuucaguagcgagauggccaaaauggacgaaaacuuuuucaugcgccuggaggaguccuuuuucaagcuaucugauaaaucggaacaaaauaaguuucccuacgcgcuuuucaagaacgagauugaagagaaggcuuauuaccgacaguuuccuacaaucuaucaccugagaaagcaucuuauggagcacgaagagucagaccugaggaaaauauacuugggucuccaucacauccugaaguaucgggggcauuucgugcaggaaggacagaaaauggauguugccaauauugacauccaaggcaaccugaaggagcucuuuaaugcauuaaacgaaaauuucagcaacaaagaggaugacuuugagcaggaacguaugaaggauggcgugaagcgcgccaaaguccuguucgacaccgagaagcucgcugcaguggaagagauuuugaaagaaaagaucaguaaauccuggaagguaaauaagauaucuaaagggauucuggccgagaagaaagaccuaccaaucuucaaggcuauuguuggaaacaaaaucgaucucgccgguaucuuugacugcccggauuacgcggagaaggugaaugaaagcauuaaggagcugaaagacaaggucuacuucaacaaagaagauuuugaggaaacuuucgagaaacuuucccagcuguugaaagaggaggaacucgaaauacugaucuuagcaagaaaguguuaugaggccgugcugcucgcugacauuaugcagggcgagcaaucacuuagugaugccaugguggcaaaguacaacgaccacaaaaaggaucuggucaucuuuaaaaaguucguuauagacuauuuuagcgaagauguguacuucgacuuguuuaaaaauacacagcuagcugggaacuaucacucuuacguaaagggagagaggaaaggcaauaaguucaaccaugccucccuggacgauuuuuauaaguucgugaaaaaggaacucgacaaaaaggcggaggaacugucagagcaccccgucuacaaacagauucuucagaagaucgagcuggaaaccuuuuugccuaagcaacggauguucaaaaauggugccaucccauaccaggugcaucuccacgagcugcgagcaauuaucaagaaacaggaaaagcgcuuccccuuuuuagcugagaaaauuauaaucaaggauaaccaaaaggacauuagcgaauauaaaaucgagacgcugaugaaguucagaaucccuuacuauguugggccacuaauugaggccagggaaggagagcucggcaaaaagcggacuaauuacagucgcuuugcuuggaugcagaaaucucccgaaucccagaacauaggcaucaccccuuggaauuuccacagcguggucgauaaggacgccucggcaucugaguuuauugaaagaaugacaggguucugcuccuauuuuccagaggagccggugcugcccaagaacucacuuaucuaccagcaauucacuguauuucaggaauugaguauuguuggauauuacgaugagcagaauaggaaacauuaccuggacggugaaacccgucggcgaaucuucgaggaucucuuuaagaaaaacagaacagugagcgccggccugcuuaggaaguggcuggucuguaaucagcgcaccucccaagaggaaaaagagauacgguuguucgggcucgaccugaagaaaaacggauuaggcucugguaauuuuaacacgaaguauacuacauaccuggaucuaaaggacgcugggaucaccgaaaaacagcucaagcagcacaaagauuucuucgagaagauugugaaauaucagacuaucuuugaagacaagaagauucugaaaagaaggaucauacuuuugaacgaggagcaaccucugcucagcgaggaacagauuaagaaucuggcgaaaaagcauuacacaggcuggggaaacuuaucacugaaacuuaucgacggcauucaggauaaggggaagaccaucuuggacuaucucgaaacgcaggauuacaaucaaaaccugaugcagcuaaugaaugacgagaacaaaaguuucgaaaugcagauagagcaagcacgcgccggaaagguccaguuugguaaaaucgauuauuccuucguggagcagcuggcuggcagcccagccauuaagcgagggaucuggcagucucuccaaauuguugaggaacugguggcauuucuuggaaaagaaaauaucaagaagauaguaauugagauggcccgggaaaaccagucaaguaaacguaccaagagcagacagaaacagaucgaggcuuuguaccaaaaggucacaggcgaccugaaaaaugagcaggaaaagaucgaugugaugcagaacuucgacaaugagaggguuuuucuuuacuaucuccagaacgguaagugcaugcacuccggggaaaaacuggagcuuucucaacugucggaguacgaaauugaucauaucauuccccagacuuauauaaaggacgauagcuucgacaauaaaguguuggucacccgcaacgccaaucagcaaaagggcggagaugugccuuccuacgacguaaucgacaaaaugaagucauauugggagaaacucaaggaaaacaaccugauuagugagaagaaauuugcaaaucuaacaaagggcaaauucgaugaccagcagcugucuggguuuaucaaccggcagcucguggaaacuagacaaauuaccaagaauguugcgaucauacuggauaaaaucuacaacgacgaggcuaagaaugagaaggaagucgccauuaucacacuuaaaagcgcauugaccucccaguauaggcagggaauuaucuacgugccaaacgaugacuucgaugagcugaaguuagugucaaaaacuaauagccgacucaaggaagucaaacugcacgacgguuucuacaagguucgcgagauaaacgauuaucaccaugcccacgacgcuuaccuuaauaacgugguggccacguaucuguacgaagcaaugcccgaucuacggccgcucuuuguauauggcgagcauucuagagagauucacaagagguuccuggggaaauacgcuacaacccguaagggacaguuuaaacaauugcuggucgacaugcaggacgaauauuggaugcgcaaggauaaagagggcaauuucaucgacggugaaaucuuauggcggagagaugaggugcuccagauuguuaagaaggugcuggacuacaggaacauacagaucacuaaaaaguuagaaaugauggucaccgggggcgaggagaaauccuuuuaccaagauagucgaugucggaaggacaaaacagccauuccuuauaagaccaauugggaucccagcaaauacggaggcuucaagucuccacgcacugcguaugccaucccugugauuaagaaaaacaagcccaaacuggaaccaguuuugcucgugaauagauccaagguagagacagacgggcaguuugauugcgaaaaauucaaggagcugaaccccacgcuaaagauccugggacagccuauauggaaauaccagucauuugagauguucgacggcaccaagagguauaucgcuagugcaagcgaaauucacaaagguaaccaaaucaaguuuucgcaggagcauaugaaauucauuuccuguugccagaaguacgaugaagucaagaauaaacuugccuuugacuucgugaacgagucuaagcaccucuuccaagaaauccugacugcuauaaaagauaauauucaucgguaucgauugaucgccgaggggaucgaggugcacagaaaguuuagcaacaugcuggaaaauauugagaaauuaucaacacaggaacucgucgacaaccugcuugacgcaaucaauauaaccaguguuggaacaacuaacaaugcguucggccgcgugagguacaaggguuccuaccugaacgagauuuggucugccaccuugauccaucagagcguaacgggccucuaugaaacccgugagaagcugauuuga

SEQ ID NO: 3371 - RNA, 4323 nt, Artificial Sequence
  Cas9 variant
augaagaccauccugggccucgaccuugggacaaacagcauuggaugggcccugguggagcaggauuucgaaaauaaacaagguuugauauuaggcaugggguccagaaucauucccauggacgcuggaaucauuggcaaguuugcagaggguucuucaaucagucagacugccgaaaggacgggguaccggagcauacgccgacugcgugagagacaccuacucaggcgggaacgccugcauagaguccuuaacauccugaaauucuugccugagcacuaugcggcugagauugauuuugaaaagagguucggacaguuucucgccgagaccgaaccaaaacuggcauggaagaaguccgccgagggcaaauucgaguuucuguuccagcggucuuuugacgaaaugguugcugauuucaaggcaaauggccaagacaucaaaauuccguacgauuggacaaucuauuaccuccgcaagaaagccuuaacucagaagauaucgccccaggagcuggcuuggauuauccuuaacuuuaaucagaagcgaggguauuaccaauugagaggagaagaggaagaggagaacccuaauaaaaagguggaguucuauucacugaaaauuguagacguggucgccgaugaacagccaaacaagaaaggugacaccugguacagccuacaucucgaaaauggcuggguguacaggcggaguuccaagaucccccuguaugauuggaaagacaagguucgugauuuuaucgugacaaccgacauuaacgaggacgggucugaaaaacuugauaaagacggagaggucaagcgcagcuucagagcgccuaaagaggaugacuggacucugauaaagaaaaagacagaacaggagaucgaacaguucaaucaaaccgugggcuccuacauuuaugaggcauugcucgauaacccaacgcagaagaucagggguaaacugguacggacuauagaacgaaaguuuuacaaaucagaguuaaagaaaauucuggagaagcagaucgaacuccaacccgagcuuuucaccgaagaccuguauaaugccugcgcucgcgaguuguacagaaguaacguugcccaccagcagcagcuaagcucuagggauuuuguguaucuguuccucaaugacaucauauuuuaccaacggccucugcgcucccagaagucacuuaucagcaacuguagucuggaguucagaacaauuaaagauaaggacgggaacggacagauaaucuacuugaaagcaauuccaaagucuaauccguauuaccaggaauuuagggucuggcaauggcucuauaaccugaaaaucuucacuaaggaggaugacaaggacgugaccaaucaguuuaucaacaaaguggaagauuuagaggcucuguucgaauuucuaaugaaucagaaggaggucaaccauacagacauucucaccuaccugauagagcccaucguuaaauccaaguauccuaaugccaaaggcaaggcguucaaagaugaacuuaagaaggaguugaaaaaguaccguuggaacuauguguacgacgccgauaaagacgaaagcaagucguacccaaugaaugagacgcgguaugaacugcgaaaaagacucgauaagguagagaacgugcccgcagacuuuaugacuaggaagauugagcagcaccuguggcacaucauuuacucugucacagauaaaaucgaguucgaaaaggcucuuaaauccuucgccaauaaguaugaccugcaucaagaaucauuuguggagaacuucaaacgcuuuaagccuuucgauagugacuacggcaccuauagcgaaaaggcuauuaaaaaguugcucccacugaugcggguugggaaauacugguccugggagggaaucgauaauaacacuaagaaaagaauugguaagaucauuacaggcgaguaugacgaaaccaucaagaauagggugcgcgagaaagccauagacuuaacggaagagaaccacuuucaggggcugcagcuauggcucgcacaguacauugucuacgaucgacauucugaggccgacaucgcuggaaaguggaacagcguggcggaucuggaacaauaucuuucagaguucaaacagcacaguuugcggaaucccauuguagaacagguuaucaccgagacacugcguguggucagagacauauggaagcaauacggcaaaggugcaaaggauuauuuugacgaaauccacauugagcucgggagggagaugaaaaacacugccgaggaacgcaagcggcuguccagcaucauuucugaaaaugagaccacaaacuuaagaaucagggcuauacuggaggaacuuauguacgaugagaauauggaaaacgugcgaccguauucaccuaugcagcaggaggccuugaagauuuacgaagacggcguccucaguagcuccguggagauccccgaagauaucgagaaaauuucuaagaaaucggagccaacuaagagcgaaauccagcgcuauaaacuguggcuagagcaaaaguaccgguccccuuacaccggaagacccauuccacugucaaaacucuucacacccgcauaucagauagaacauaucauuccucaggccagguuuuucgacgauggcuuuaguaauaaaguuaucugcgagucugaggugaacgcucugaaggacaaaaugcuuggguuggaguucauucagaauuacuauggacaaaagguaaccacuagcuuuggugaagucacgauccugacagaagaugccuacaaagcauucgugaaggagcacuaugacaagaaccguuccaaacgcaauaaguuacuccuggaagagauaccagagaaaaugaucgaccggcagaugaacgauaccagauacauuucaaaguauaucagcaaaguucuuucuaaucuggugaggggcgaaaaggacgaugagggggucaacuccaagaauauuaucccgggaaacggcaaaauaagugguacuuugaagcaggacugggggcucaacgauguguggaaugaccugauucuaccccgauucgaacggaugaaccagcugaccaauagcacagauuuuaccgcguggaacgagaaacaucaaaaguuccucccuacuaucccacuggaacuuucuaaaggcuuucagaagaagcgcaucgaccacagacaucacgcuuuggaugcccugauuauagcaugugccacaagggaccacguaaauuuacucaacaauaaacaugcuaagucccggaacgagcgauacgaucugcagcacaaacuuagacauacgacccccuggcaagacaaggagggaaaagugcgcacuaaguucacagaauuuaaaaagccuugggagaccuucacacaggacacuaagaaagaacuggagaagaucguugucucauuuaaacagaaucuaagggugauuaacaaggccaccaauuacuaugaaaagaucguggauggcaagaaggucauguucaaacaggaggggguuaacugggcaauucguaagccaaugcacaaagagacggugaguggaaagaucgaccucccccgggugaaaguaagcaaggguaagauacugaccgcuacaagaaaaucguuggauacuuccuuuaaugccaagaccauccugucuauuacagacacuggcauccaaaagauuuuacucaacuaccugaaggcgaaagggaauccggaacuugccuucagcccugagggaaucgaagagaugaaccagaacauaucacuguauaaugauggcaagccacaccagcccauuuugaaggucaggguguuugagcaggguaguaaauucccucucggggaaaccggcaacaagacgacaaaauacguugaggcugcaaagggaaccaaucuguucuuuggcguguaugaaaacaaucaagggaaacgcuccuacaacacuaucccccuaaaucuggucaucgagcgacagaagcagggacuuaacucugugccagaaacaaaugagaaaggccauagacuccuguucagcuuguccccuaacgaccugguuuaugugcccauugagggugaaguauuugauaagaccaauccagacgucaaccggaucuacaagauagugucauucagcgggagucagauguuuugcgugaggcaagaugucgccacuucuauuguuuacaaauuagaguucuccagccucaauaagauggaacgcaccaucgacggaauuaugaucaaagagauauguauuaagcugaaaguggaucgucuuggcaacaucucgaaggcuuga

SEQ ID NO: 3372 - RNA, 4323 nt, Artificial Sequence
  Cas9 variant
augaagaccauccugggccucgaccuugggacaaacagcauuggaugggcccugguggagcaggauuucgaaaauaaacaagguuugauauuaggcaugggguccagaaucauucccauggacgcuggaaucauuggcaaguuugcagaggguucuucaaucagucagacugccgaaaggacgggguaccggagcauacgccgacugcgugagagacaccuacucaggcgggaacgccugcauagaguccuuaacauccugaaauucuugccugagcacuaugcggcugagauugauuuugaaaagagguucggacaguuucucgccgagaccgaaccaaaacuggcauggaagaagaaugccgagggcaaauucgaguuucuguuccagcgguccuuugacgaaaugguugcugauuucaaggcaaacggccaagacaucaaaauuccguacgauuggacaaucuauuaccuccgcaagaaagccuuaacucagaagauaucuccccaggagcuggcuuggauuauccuuaauuuuaaccagaagcgaggguauuaccaauugagaggagaagaggaagaggagaauccuaacaaaaagguggaauuuuauucgcugaaaauuguagacguggucgccgaugagcagccaaauaagaaaggugacaccugguacucacuacaucucgaaaacggcuggguguacaggcggagcaguaagaucccccuguaugauuggaaagacaagguucgugauuuuaucgugacaaccgacauuaaugaggacggguccgaaaaacuugauaaagacggagaggucaagcgcucuuucagagcgccuaaagaggaugacuggacucugauaaagaaaaagacagaacaggagaucgaacaguucaaccaaaccgugggcagcuacauuuaugaggcauugcucgauaauccaacgcagaagaucagggguaaacugguacggacuauagaacgaaaguuuuacaaauccgaguuaaagaaaauucuggagaagcagaucgaacuccaacccgagcuuuucaccgaagaccuguauaacgccugcgcucgcgaguuguacagaaggaauguugcccaccagcagcagcuaucaagucgggauuuuguguaucuguuccucaacgacaucauauuuuaccaacgcccucugagaagccagaagucucuuaucuccaacuguucacuggaguucaggacaauuaaagauaaggacgggaauggacagauaaucuacuugaaagcaauuccaaagagcaacccguauuaccaggaauuucgugucuggcaauggcucuauaaucugaaaaucuucacuaaggaggaugacaaggacgugaccaaccaguuuaucaauaaaguggaagauuuagaggcucuguucgaauuucuaaugaaccagaaggaggucaaucauacagacauucucaccuaccugauagagcccaucguuaaaaguaaguauccuaacgccaaaggcaaggcguucaaagaugaacuuaagaaggaguugaaaaaguaccgguggaauuauguguacgacgccgauaaagacgaaucuaaguccuacccaaugaacgagacgcgauaugaacugagaaaaaggcucgauaagguagagaaugugcccgcagacuuuaugacucgcaagauugagcagcaccuguggcacaucauuuacagcgucacagauaaaaucgaguucgaaaaggcucuuaaaucguucgccaacaaguaugaccugcaucaagaaucuuuuguggagaauuucaaacgguuuaagccuuucgauuccgacuacggcaccuauucagaaaaggcuauuaaaaaguugcucccacugaugagaguugggaaauacuggaguugggauaucauugacgacaagacuaaaacaaggaucggaaagauuaucaccggugaguaugaugagacgauaaagaaccgcgugcgagaaaaagccauugacuuaaccgaggaaaaucacuuucagggccugcagcuauggcucgcacaguacaucgucuacgaucggcauagcgaggccgacauugcugggaaguggaacuccguggcggaucuggagcaauaucuuucugaguucaaacagcacagcuugcguaaccccaucguagaacagguuauaacagaaacucugagaguggucagggacaucuggaagcaauacggaaaaggcgcaaaggauuauuuugacgagauucacaucgaacucggucgcgagaugaaaaauaccgccgaggaacggaagagacugucaaguauuaucuccgagaacgaaacaacuaauuuaaggauacgagcuauucuggaggaacuuauguacgaugagaacauggagaaugugcgcccguauagcccuaugcagcaggaagccuugaagaucuacgaggacgggguccucucuucaaguguggaaauccccgaggauauugaaaagaucagcaagaaauccgagccaaccaagucugagauucagcgguauaaacuguggcuagaacaaaaguacagaucgccuuacacaggcaggcccauaccacugagcaaacucuucacccccgcauaucagaucgagcauauuaucccucaggcccguuucuucgacgauggauuuuccaacaaaguuauuugcgaaucagaggugaaugcucugaaggacaaaaugcuuggcuuggaguucauccagaacuacuaugggcaaaagguaacuacgaguuuuggagaagucacaauacugaccgaggacgccuacaaagcauucgugaaggaacacuaugauaagaaucgcucuaaacggaacaaguuacuccuggaggaaaucccagagaaaaugauugacagacagaugaaugauacuagguacaucagcaaguauauuuccaaaguucuuucaaaccuggugcgaggugagaaggacgaugaaggcgucaauagcaagaacaucauaccggggaauggaaaaauuaccggcaucuugaagcaggacuggggucucaacgauguguggaacgaccugauccuaccccgguucgagcgcaugaaucagcugacaaacucuaccgauuuuacugcguggaaugaaaaacaucaaaaguuccucccuuccguaccacuggagcuuaguaaaggguuucagaagaagagaauugaccacaggcaucacgcuuuggaugcccugauaaucgcaugugccacacgggaccacgugaacuuacucaauaacaaacaugcuaagagccgaaaugaaagauacgaccugcagcacaaacuucgccauacgacccccuggcaagauaaggagggcaaaguuaggacuaaguucacagaguuuaaaaagccuugggaaaccuucacacaggacacuaagaaagagcuggaaaagauugucgugaacuuuaaacagaaucuacgugugaucaacaaggccaccaauuacuaugagaaaauugucgauggaaagaagguuauguucaaacaggaaggcgugaacugggcaauccggaagccaaugcacaaagagacggugucugggaagauagaccuccccagaguaaaagucuccaagggaaagauccugaccgcuacaaggaaaucauuggauaccaguuuuaaugccaagacuauucugagcaucacagacacugguauucaaaagaucuuacucaacuaccugaaggcgaaaggcaauccggagcuugccuucucgccugaagggauagaggaaaugaaccagaacauuucccuguauaaugauggaaagccacaccagcccaucuugaaggugcgcguuuuugagcagggcucuaaauucccucucggugagaccgggaacaagacgacaaaauacguggaagcugcaaagggcaccaaucuguucuuuggagucuaugaggacaaccaaggcaaacgaagcuacgauacuaucccccuaaauauugugaucgaaagacagaagcaggggcugaacucaguuccagagacaaaugaaaaaggacaucggcuucucuucagucuguccccuaacgacuugguguauguacccauagagggcgaggucuuugaugaaaccaauccagacgugaacaggauuuacaagguggucucuuucagcgguucccagauguuuugcguucgccaagauguggccacuucaaucguauacaagcuggaguucagcaguuuaaauaaaauggaacguaccauugacgggaucaugauaaaggagauuuguaucaaacucaagguggacagacugggaaacaucucuaaagcuuga

SEQ ID NO: 3373 - RNA, 4332 nt, Artificial Sequence
  Cas9 variant
augaucaagcugcucuaccuugagaaacugaagcaguauaccaugaaaaagauuuugggcuuagaccuggggacaagcuccauaggaugggcccuagugaacgaagcugaaaauucugaugaagucucaaguaucauuaaacucgguguuagagugaacccccugacuguagacgagaugcaaaauuucgaaaagggcaagagcaucacgaccaacgcagauaggacacuuaaacgguccaugcgccgaaaucugcagcguuacaaguugagaagggacgcccucauugagcugcugaaaaaggugggguuuaucacugauaaaaccauacucucugagcagggaaaccggacaaccuucgaaacuuaucgcuuaagagcgaaggcugccgaggaagagaucucgcugaaggagcuugcaagggucuugcugaugauuaauaaaaagcggggcuacaaaucaagccgcaaggccaaaggugaagaggaaggggcucuaaucgacggaauggagauugcaaagaaacucuaugaugaagaccugacaccuggccagcuuugccugcaauugcucgagaguggcaagaaguuuuucccagauuuuuaccgauccgaccugcaggaggaguucaacaaaaucugggauuuucagaagcaguucaauuuauuuucuuucugugacguggccaaagaggaaguuaaggggaaaaacaagagccaaaccugggcuauacuggccaaguauuuuguggagacgaaaaaggucaauguguggaacgaacacgaggcgcagacugagaauagagaagagguauacaaacucguuggacuuaagaggaccgugaaaggugaggaacugaagaaggaaaacuaccgguggcguguccaggcauugacagagcagcuagaucuggagaaaauugccguggugcuccaagaaaucaauggccagauuuccgcuucaaguggguaucugggagccaucagcgaccgcucuaagguccuuuacuucaacagacagacuguuggccaauaucagauggcagagcugaacaaaaauccgaacauguccuugaggaauaugguguuuuaccggcaggacuaucucgaugaguucaacguaaucugggaaaagcaggcugaguuccauaaagaacugacccccgaguuaaagaaggaaauucgagacauaaucauauuuuaccaacgcagacugaaaucacagaagggucuaaucagcuucugcgaguuugaaaauagggagguggucguggagaaagaagggaagaaacagacaaagauaauuggauguaaaguuaucccucggagucacccacucuuccaggaguuuaagaucuggcaaacccugaacaauauugaaguguucgucggcgagaagaaaggcaagcgcaaaaagucuaacguguccagcgaucuuuuuggggacacggaagaugccuugaucacugagggaagaagguuccuguaucaggaggagaaaaagauucucgcgaaggaacugucgauuaaaaagggucuuacaaaagccgaaauccugcguuugcucuuugagaauccccaggaacuggacauuaacuucaagcagaucgauggcaaucaaaccggguuugcauuauucucugcuuacuccaacaugaucgagaaauacggauaugagccucuggacuuuaagaagccagccgaagaucuaauuucacagcucaaaacuguauucacagaccugggcuggaauaccgaucuuuuguucauagaccuggacaaggagaacaaagaaugggagaagcagcccuacuuucggcucuggcaucuguuauauaguuucgagggugauaauacgccuaccgggaacggcaaacugaucgaaaagauuaugcagcuuugcggaaucgagaaggaauacgcuauugaguuggccaacguuagccuccaagacgauuauggcucccugucugcaaaagccaucaagaaaauacuacuguaccucaaggaagggaaucaguaugacauggcuugugaguacgcgggauaccgacacagcaaaucaagucugacaaaggaggaaaucgagaacaaagugcuuaaggauaaguuggaaauucugccgaaaaauuccuuaagaaacccagucguggagaagauccucaaucagauggucaacgugauuaauacuguuauggaaguguaugguaggcccgacgagauccgcguagagcuggcacgggaacuuaaaaagagcgccaaagagagagaggaacugaccaaggcugucgccaagaacacaagggaacaugaggagauacgcaaaguguugcaaucugaauuuggcaugauuaauguuucacgaaacgauaucauucgguacaagcucuaugaggaacugaaagacaauggguacaagacucuauauaguaaccaguacaucccucgugagaaacuguucagcaaggagauagauaucgaacacauuaucccacaguccagacucuuugacgauucucugucgaauaagacccuugaguauaaaagcauuaacaucgaaaagggaaauaaaacagcauacgacuucgugaaggagaaauacggcgaagaggguuugcagcaauaucugaacaggugcgagaacuuauguaaggauaagaaagccaagcuccgcaaacugaagauggaacuuaaugagauacccgacggguuuauugaccgggaucugagaaacacccaguacaucgcuaaaaaggcccuauccaugcucacugaaaucugcaggcgagucguggcaacgacaggcucaauuaccgacaagcugcgcgaggauuggcaguugguagacgugaugaaagaacugaauuuaccuaaguaugaggcgcucggacugguugaggucuacgaagauaaagacggccggaagaucaaaagaauuaaggauuggacuaaaaggaacgaccaccgucaucacgcuauggaugcccuuaccguggcauucacaaaggacguguuuauacaguauuucaauaacaagaaugccgcuugggagagugauucuaaagaacauaccaacaucgucgggauuaagacucgcuacuuugagagcggaaaagccguuccacccaucccgcugggucaauuccggguggaagcaaagugucacuuggagaaucuccugguguccauuaaagcuaagaacaagguagucacaacgaaugugaacugcaucaaaaagaaaggcgggaccuauaagaauacucagcagacaccuagaggacagcuacaccuggagaccauauacggcucacauaaccaauacguuacaaaaaucgaaaaggugaaugccagcuuugacgcggucaagauugccacugugucuaaacaggauuauaggaacgcacuucucaagcgacuggagguuuucgguaacgaccccaaaaaggcuuucaccgggaaaaauuccuuggaaaagaacccaaucuaccuggaccgggcccagacgauucaagugccugauaagguacagaccgucgaguuagagacagcuuauacuauccgcaaacccguggacccaacccucaauguggauaaggucguugacaaaaagauaagacugauucuugaacagaggcugaaagaguacggcggagaugccaagaaagcauuugugaacuuggacgaaaaucccaucuggcucaacgaggaaaagggcaucaguauuaagcggguaacaauacgagggaucagcaaagcgcaggcccugcacgauaagaaagacaaggauggaaauuucauucuagacgagacuggcaaaagaaucccuguggauuuugucaacaccgguaauaaccaucacguggcuauuuaucgcaagccaguucuggacaagaaagggcaagugaucuucgacgaugagggaaauccgauguacgaacuugacgaggaugucgugcccuuuuucgaagccguuacgagggcaaaccucggcauaccuaucauugacaaggauuauaaaaagucugaggguuggcaguuucuguucuccaugaaacagaaugaauacuuuguguucccaaacgagaagacaggcuuuaaucccaaggaggucgacuuguuagauccugacaacuacgcuaugaucucaccaaaucuguuccguguacagaaaauugggcucaacgauuauaccuuccggcaucaccuggaaacuacaauccaaaacgaccuuaaguuuauaaccuggauuagauguggaaaaaguggcaucaaggauaucgugaaaguuaggauuaaucacaucgggcagauagugagcgucggagaguacuga

SEQ ID NO: 3374 - RNA, 4332 nt, Artificial Sequence
  Cas9 variant
augaagaaaauccugggccucgaccuugggaccgccagcauuggauccgcuuacgugcuggaggcagaaaagucugccgaucagacaaaaauagucuauuuggguacuagaaucauuuuaucaagugcggacgcugagaacuucagcaagggccuguccugcucucccacgaccgauaggacauuuaaacggucgaugcgccgacgucuacaaagauacaagcagaggcggucaagccucauccagcaguucaagaaaauugggaucauaacuaauaccgaacaaaucauucgcgagccuaucagugaaacacacgagcugcuuagaauuagguccaaggccguuucugagcaugugagccuggaagaguuugcacggaucuugcucaccauaaacaaacgccgaggauauaaguccaauagaaaaacuucaaagaguacagaagaggacggcaagcugguagaugccauggcugugaccaaagagcugauuaagcucaaaaagacgccaggucaguacauguucgaaagguuuaaacgggggaaguaugcagagaucgacuucuacccguuugauuuaauuaacgaacugaaacagaucugggagguccagggacaaaaguaucccgacgugcuuacugaaggcuugcugagcucucuacucaagcagaaaaccggcaaggccaaagagcugaucuacuccaagucagaucuuaauccugcugagguuccaauugacuaccagaaagggaagaagcugcguaaaacaauauugaacaaguauuucgccuacgaaagccgcagucucgcggugacuaauaucauucccgucgagcaggcaaucaccgccauaguggcuauuuguaaacaaaucaacaauucuuccggauaucugggugccaucggcgauagaagcaggguauuauacgcaaacaaucagacaauugggcaguaucuguacgaacggaucaaggcuaacccucacgaccgcauucgaggagagguuuucuauagacaagauuaccucgacgaauuugacaggauaugggagugccagcagaauuacuauccagccauccuuaccaacgaucggaaacaguacauucgcaauagaaucaucuuuuaucaaaggccccugaagucgaagaaaucugaguuggcguucugugaauuugagucccgugaaguggagcauaacggcaagaaauacacggaaggucuacacgucgccccuaagucaaguccaguguuccagcauuuccggcuguggcagcgacucgggcagauugaggugagcccgcugagaaaaugggacaagcaauccaacgagcuuuuugaacagcagaauaacgcagauagggagggaauacugaauacugaagcuaagcagaaauuguucucuuaucucaaccuguuagaccaccugacagauaaugagauccuaaacauucucggcuacagccccgacaaguggaaaaucaauuuucgcgagauuaucggcaaccggaccaauaaccugaugaugaaggccuucuuuucaaugaaagaaaugacugauggggagcaaauagacugggaaaagaaucuuacaaaaaucaccaacggacagaguuugauuuccccugagcagaucgucgaucugauuagacaguucuuugaaagggaggguaucacgaccagccuccuguauuucgacccagcuacagauaauuuucgcgagcaaucucacuacucacuuuggcaucuguuguacaguuaugaagacgacaacagccccacuggcaccacaucccucugcaagacucuggccaagcgauacgggauaccucacgaguuauguccacugcuagcaucucucaccuucgaacggcaguauggaucgcugagcacaaaagccaugcguaaacuuuugcccuuuaugcaggagaagagauacgaugaggcuugcgaacuggcgggcuauaggcauuccgcauggauuaccaaggaggaaaaugccaaacgcacucucaagaacaagcugccguuacugcggaaagguucacuuagaaacccuguuguggagaagaucuugaaucaaaugacgcacguaauuaacacacacaucgcugaauacgggaaucccgacgagauaaggaucgaaauggcccgagauaugcaggcaaacaguaaacagcgcaaggccaugaccgcugccauuacugaggcaaccaaacggaauacacaguucaucgaggaaauucaaaaggaguuuggcuucaacccaucuaagaaugaccucaucaaauauaagcuguggaaagaacuagcgccucugggaaacaagacccucuacagcaauauauacauucccaaagaggagcuguucacugcuaaguuugaaaucgagcauaucauuccaagagcccuuuucuaugaugacuccuuuucaaacaagacauuggaacugaauagcgugaacaaauuaaagggcaauaaaacggcacucgauuaccuggacacccuugggcaggagaaggccaacgauuauauccugagggucgaagaguugaaaaagauuggagcuauaacucaggccaaauacaagaagcuccugauccgugagaaagaccuaggugaugacuucacaaaucgcgaucugaccaacacacgguauauuaucagacacgcagcugacagggaccucacuaacacccgauacauuauccggcaugccgcggauaugcugcuucaggugacgcccucuauaguucacaccaauggcuccaucacagccauuuugcgcagagacugggggcuguuagauauccucaaggaacugaaccuuccuacuuaugagaguauugacaggaaaaucagcgauccagaagagaagcugacccaaucuguggaccggaaagauggacaggcuauaaagaugauuaaggacugguccaaacgagaugaccauagacaccacgcaauggaugcccuaaucacagcucucacuacccgcaagcauguccaguaccugaauggcaacucaggugccgaagagacggacaaagcacagaaguuggagcaacugaaagcguuaaggaagcagcucaucgggagugauggccacuuuauuccgcccaugcaugacauacgugugcaggccaaggaagcucugagccggguaaucauuucgacaaaaguuaagggaaaagugaccacuccuaauacaaacaucauuuguuccagagacaagaccacuggcaggaaaaucuacguccgccaaaccacacuuacgccacgaggggcccugcacuuggauaccaaguauggaauaaauagauacuaucaggagcgggaagugucuaucgguagcaagcucacucaggaggaaauuaggcuggucucaaguccccacauccaguccauucuacuggagcgccuucgugcauucgacaacaauccuaaaucugcuuuuacaggcagaaacagcguggauaagaaaccacucgaggacaagaauaaaaagcugguuuacaccgauaagaaagugaagcaaacaaucuuggccaaccgguucguaaaaagggaccgcgucaauuccaagcuggauuuagacaacgugauagauacugggauuaaacgaauccucgaaagacggcugaagcaguauggaggcaaauacgagaccgcauuuucagaccuugaaaauaaccccaucuggcugaacgaggagaaggguauugccaucaagagcguuaggauacgcgggaaaaauaacacgauuacaaucagacagaccaauacuugcaggauuaaguauguggcuaacgauaauaaccaucacuuggcggucuacgcccucccggacggcaguaucaaagacgauauagugucuuucuuugacgcaguagaacggucccguaagcgccugccuauuaucgauaaacauaagaaucagagccuaggauggaaguaccuguucucgaucaaacaaaacgaguauuuucuucucccacaacagguggaaaagauugacaucgauaccggcgagauuucaaugcagacaacuuucucucccaaagaccugagucacgaauacauaaugaauccugauaacuaugcugaguuggccucccauaucuuccgaguucagagcauuucuaagacaccccaggggaauagagacgucaggaucuacuuauuuaaacagcaguauaucagcggaucccaaaaggauucacugcaccucaagggcauuacccaccggcagauaaguagcgccaaagaccuggcugagcuugugaagauccgcgugaaccaucuggguagaauugucucuguuggggaaaaauga

SEQ ID NO: 3375 - RNA, 4341 nt, Artificial Sequence
  Cas9 variant
auggugaagaacauccugggccucgaccuugggaccaauagcgucggaugggcccugauuaaacaggauuucgagaacaagcaaggugacauauugggcaugggguccagaaucauucccaugucucaggauguuuuaggagacuuuggcaaagguaauucaaucagucagacagcugaaaggacuaaguaccggagcgugcgccgacugcgugagagauuccuacucaggcgggaacgccugcacagaguacuuaacgugcuggauuuucuuccugagcauuaugcaucccagauugacuucaauaaaagguuugggaaguucaaggaagagacggagccaaaacucgccuacucuaacgauggauuuaucuucaagaaaucguuugaagagaugauaucagacuucaagacccaccaaccggaacugcuggagaauaacaaaaagguccccuaugauuggacaaucuacuaucuccggaauaaggcguuaagccauaaaauugagaaggaagaacuggcuuggauccuuuugaacuuuaaucagaaacgcggcuacuaucagcugcgaggcgaagaggaagaggagaacccuaauaagcuaauugaguucuacagucucaaaaucguggacguucuggccgaugagccacagaaggggaaauccgacauaugguacucucuuauucuggaaaacggauggaucuauagaaggagcuccaagauucccuugcucgauuggaaggguaaaacucgggacuuuaucgugaccacagaccugaaugaugacggcucagucaagaccgauaaagaggggaacgaaaagcguaguuuccgcgcaccuggagagaacgacuggacuuuagugaaaaagaagacagagcaagaaaucgauaauagcgacaaaaccguaggcgccuacauuuaugaggcucugcuccagaacccaaagcagaaaauaaaggguaaacuuguuagaacgaucgaaaggaaguucuacaaggcagagcugaaacagauuuuggaaaagcaaauggaguuucaccccgagcuacggcaggaugaccuguauucugauugcgugcgagaacucuacaaaaauaacgaggcccaucagcugacucuuuccaagaaagacuucguccaccuguuuauggaagauaucauauucuaucaacgcccuuugagaucacaaaagagcaguauuucuaauuguacccucgaguuuaggaaguacaaagacgagaacgggacagaacacauccaguaccugaaggcuuuaccaaaauccaauccguauuaccaggaguuccggaucuggcaguggauguauaaccugaauauuuacaagaaagaagacgauacuaacgugaccaaggaguuucuaaauagcaaagccgacuucgaaucgcucuuugaguuccugaacaauaagaaggagguggaucagaaagcgcuuuugaagcauuuuaaaaucaacgacaagacacaccgcuggaaauaugucgaagauaagaaguaccccugcaaugagaccaaaacgaugauuucugaaagacugaagaaaguugagaacauauccgacgauuuccucacuagggaaauggagcagaagaucuggcauauuaucuauucagugaacgacaaaguaaaguacgagaaggcacugaaaaguuuugccgaaaagaauaaccuugaugagagcuccuucuucgaggcuuuuaaaaaguucccuccauuuaaaucugaauacggagccuucagcgaaaaggcaaucaagaaacuguugccccucaugcgucugggcaaguauugggacgaugacgagauuuuaaaauacucagauauauauuuuaagaauaucgaguaccugcuaggcgugcucaaacagaaggacaaaaacauuagugacgauaaucggcaaaacuggaauaaguccaucaacaauaagcugcgagaggaacuugaaauuuuccagaacgcugagaucgagagcuuucagggguugagacugcacauagcccaguauauccucuacggaaggcacucugaagcggccaugcuggguaaauggaacucagcagacgauuuagaggaguuccugaaggaauuuaaacaacauagucuucgcaauccuauugucgaacaggugaucacagagaccuugcggguugugaaggacauuugggucaaauauggcaauggggcuaaggauuucuuuaacgagauccacauagaacucggaagagagaugaagcugccagccgaagacaggaaaaagauuacuaaucagaucagcgagaacgaaaacacaaaucuacgcauuaaagcucugcucgccgagaugaugguggauuccucuguagagaacguucgacccuucucgccgaugcagcaagaaauccugaagauauacgaggacggcgugcuuaauagcgauaucgaaauugaggacgauaucuugaaaauuuccaagaccgcacagccuucacccagugaccugaagcgguacaaauuauggcucgaacagaaguauaaaucuccauacacgggucaaaucauaccucugaacaaguuguuuacccccgaguaugagauugaacauaucaucccacagagccguuacuucgaugacuccuucucaaauaaagucauuugugaggccgcugugaacaagcugaaggacaauuuuaucggguugggcuucauuaaacaguuuggaggcacaauagucgaaugcgggaacggaaagagcgugacuguucucaaagaggaucaguaugaggacuucgugaagaaacacuacgcgaauaacagaucuaagaggaauaagcugcuacuggaagauauccccgagaaaaugauugaacgccaaaugaacgacacccgguauaucuccaaguacauuagugguguacucagcaauaucgucagaacagaggauggcacugacgauggggugaacucuaaaaauauaguuccuggaaacggcaagaucaccaacacacugaaacaggacuggggucuuaaugauauuuggaacgacuugauccugccaagguuugaacgaaugaaucaguuaaccaacuccacugauuucacggcauggaaugagaaccaucagaaguuucucccgacagugcccgucgaguucucaaaaggguuuaguaagaagcgcauugaccaccggcaccaugcccuggacgcucuugugaucgccugugcaaccaaagaucacguaaaucugcuaaacaaucaaagcgccaagucggacacuaaaagacaugaucucaagaggaaacugaugaaguucgaaaagguggcuuacaaccacccucagaccggcgagcguauagaacgcgagguuccaaaacaguuuuugaagcccugggaaacauucaccgucgaggccaaaaauggacuggagacuauuaucguguccuucaagcagaacuuacgggugaucaauaaagcaacaaaccacuaugaaaaguacgucgagaaggacggcgcgaaaguuaaggggagaguggaacaagcuggaacgaauugggccauuaggaaaccuaugcauaaggagaccgugucugguaaaauagaucucccacgaaucaagguacccaagggcaaaauucugacugcaacacggaagaaccuugacaccagcuuugaucugaaaacaaucgggucaauuacugacaccggaauccagaagauauugaaaaauuaucuccaguacaaggauaacaacccggaacuggccuucaguccugagggcaucgaggacaugaauaaaaacauugaaaaguuuaaugaugguaagguccaccaaccaaucauuaaagugcgcaucuucgagcuaggguccaaguuuccccugggccagucuggaaacaaaaaggacaaauauguugaagcugccaagggcacgaaucuuuucuuugcaguguacgaggauaagaacgggaaaagaagcuaugagaccauaccucucaaugaagucauugagaggcagaagcagggacugacagugguugacuugaaaggcgugaacgacuucuaccugucccccaaugauuuaguauacgucccaucagaagacgagcucgaaaacgugagcaugaucgauuauaauaagcugaguaacgagaaaguguacaaggucguuucuuuuacugguaaucaaaucuucuuugugcggcaggacguagcuaccuccauugugaacaaggccgaguucagcucgcuuaauaaaauggaacgagcgaucgggggaacaaugauaaaggaggucuuugugaaaauuaagaucgauagacugggcaacauuucaaaaguuuga

SEQ ID NO: 3376 - RNA, 4347 nt, Artificial Sequence
  Cas9 variant
augaagcacauccugggccucgaccuugggaccaacagcauuggaugggccguggucaaagaggcucagaaugauaacgaacaauccgagauaguugacguggguguaagagugaauccccugacaacugaugaaaagacgaacuucgagaaaggcaagccuaucucuaccaaugcagacaggacauugaaacggucagcccgccgaaacuuacagcguuacaagcugagaaggaaggaacuaauugagcuccugaaagagcaucagcuuaucagugaaaauacuauucugaccgagaacgggaagggaacaaccuuucagacuuuggaacuccgggcgaaaagcgcuaaggagaaaaucucccugggcgagcuggcccgcgucuuccucacaauaaauaagaagagagguuauaaaucuucgaggaaggccaaaaacggggaugaaggacaauuaaucgacggcauggagauugcaaagcggcuguacgaagagaaucuuaccacgggccaguugucacugcagcuacucaaagaagggaagaaaagccugccagauuauuaccgcagugaccuucaguuugagcuggauaagguguggaacuuccaaaagcagucccacucugacaucuugacugaugaguuuuaugcucagcucaaaggaaagggucagcgagcaaccagcgcccuguucuuagcuaaauaccaaauuuauacagccgaaaauaagggcuccagagaggacaaaaagcugcaggcguaccaguggaggguugaugcacucucaaaggaacuuacucgggaggaacuggccuuugugaucaccgagauaaacaauaacuugaacaauaguagcggguaccuaggagcuauuucugaccguuccaaagagcuguauuucaacaaugaaacagucggcgaguaccucuggaagcaaaucgccgcaaacccgcauaauucacugaaaaaccagguguuuuaucgccaggacuaccuugaugaguucgagcagauuuggaagacccaaagcgcuuuuuaucccgaaauccugacggacgaguugaaaaaggagcucagagauguaguuaucuucuaccagaggaagcugaaaagucagaagucuuuaguguccuuuugcgaguucgaaaauaaagaaauugagauaaagaacgaggacgguacuacaaccaaaaaggucaucgggcugaagguggccccuaaaagcucgccacuauuccaggaauuuaagauuuggcaaaaucucaacaaugugcugauccggaaaaagggaucuaaaacuaagaaagucgcgaagaaccagcaggccguucuuuucgaggaagagaagacaauauccgaauuggaucuggaggcaaaacaggcucucuuuaaugagcugaaccuuaagggcaaucugaaagccgacuauuguuuggaaauucucggcuacucacccaaggagugggaaaugaacuacaguauccuggaggggaaccgaaccaauaaggcuuuauaugaagccuaccugaagaucacggaucuagagggauaugacgcaaagaaccaccucaaagugaagcugaauaaagaugagguagaacuugacgauuugaaggugccugccagcgagauuaaagacaugguccaagcuaucuucaaggaagcggguauuaacaccgacauacugcauuuuaaugcagagcucgauggcaaggacuucgaaaaccaggccuccuaccagcuguggcacuuacuguauucuuacgagggggaugacagcaaaucaggaaaugagcuuuuguauaagcuccuggaaacaaaauuuggcuucaagaaagaguacgcucagauccuagccaacgugagucuguccgaugacuacgguaaucucagcacuaaggcaaugcgcgaaauuaucacccaccugaagcaaggguuuccauucacaggcagaaaagauaggcccgacgagccuucugccugcgaguuugcuggauauaagcauucaaaacacagucuuacuaaggaagagaacgaaaaacggguuuugaaggauagccuggagguguuaaagaaaaauucccuccgccagccagucguggaaaagauccugaaccagaugauuaaucuuguaaacgcccuguugaaaaaguacagaaccgagaauccgaacuucaaauuugacgagauaaggaucgaacucgcacgugagcugaagaaaaaggcggaggaacgggcuaacaugacagccaauauuaacaaggcaaaaaccgaacaugagaagaucauuaaaauccuaaagaaugaguucggccugcccaacccuacucgaaaugauauaaucagauauaggcucuacgaggaacugaaagacaacggguauaaggaucuuuacaagggagacuauauuccacgcgaaaaauuguucucuaaggagaucgacauugaacacaucauacccaaagcccggguuuuugaugacucguucagcaauaagacgauuacauacagaaaaaccaaccuggagaagggugagaggacugcuuacgauuauaucgaauccuuaggcgagaagcaacucgaagaguuucugucacgcauugagaaucuuuacgaaaucgggaaaccuagucgacugcacaaccggcguaauccacuaaagaaaguggaggaaaagggaauaucugacagcaaauauaagaagcuccugaaaaaggaguccgaaaucggcgaugguuucgucgagagagacuugagggagacccaguacauugccaaaaaggcaaaagaaauccuguuacagauuacacgcucagugcucagcaccucugggggcaucacugaucggcugagagaggacugggaucuuauaaacgucaugaaggaacugaauuugcccaaauauagggcucucggacugacaaagauggaggaccgaaaguacggccagcaaguggaaguuauuacggauuggaccaaacgcaacgaccuacggcaucacgccauggaugcgcugacuguggccuuuacaaagcauaaucacauccaguaucuuaacuaccucaacgcucgcaaaaaugagaagcauaaagagcacaacaauaucauggcaauucagcagcuggaaaccaucaagguaacagacgagaacgggaaugaaaagaggauuuucaaagccccgaugccuaacuuucgucaagucgcuaaggccuucuuggagaaugugcugauaucccacaaagcaaagaacaaaguugugacuaagaauaagaacaaaaucaguggaaauaacaagguccaggaaguguuaacccccagaggucagcuccauaaagagacgauuuacggcaaguaucaguacuauguacaaaaagaggaaaagaucgggggaaaguuugaccuggagaccauugaaaaaguggcgaauccacuuuaccagagccuguugaagaaacggcucgaggagaacggcggugauccuaagaaagccuucacagggaaaaauucucuggcuaaaaaccccaucuaucuagacgaagcccagacugagcaacugccagaaaagguuaaacuugucuggcucgaaaauuccuuuucaauaagaaaagauaucacccccgaaaacuucaaggacgagaaacugauugauaagaucuuggacgagggcgugaaaaggauuuuaaaggaacgacugcagaguuuuggaaacgaugcaaagaaggcuuucagcgaccucgagaagaauccuaucuggcugaacaaagaaaagggcauagccauuaaacgggugacaaucucgggggucgcaaaugccgagccacuucacacuaagaaggaucaucugggaaaagaaaucuuggacaaggagggcaaaccgauucccguugauuucauauccaccgguucuaaccaccacguggcuguguaccgcgacgagaaggggaaucuacaggaaaaaguagucagcguguuugaggcgguugugagagccaaccagggacugccuaucauugacaagacguauaaucaauaccucggcugggaguuccuguuuucaaugaagcagaacgaaauguucgucuuuccaaaugaaaguacagguuucaaccccaaugauaucgaccuuuuagauccuaaaaacaagaaaauuaucuccccaaaucuguuuagggugcagaagcucgcaaccggcgacuacugguuccggcaucacuuggagacuacaguugagaccaaaucugcuacuaaggauaugaccuauaaacgacugagccucaaccauauaaagaauaucauuaaggugagaaucaaccaccugggggacauuguauccgucggagaauacuga

SEQ ID NO: 3377 - RNA, 4353 nt, Artificial Sequence
  Cas9 variant
augaagcacauccugggccucgaccuugggagcaacuccauuggaugggccuucgugcagcaagauuuugagaauaaacaggguaagauaaucgcuaccggcucuagaauuauccccauggaccaggggauucugggagauuucgaaaggggcaacacagucucacagacugcagagcggacgaccuaccgcaauacacgacguuugagagaaaggcauuuacugcggcgcgagagacuacacaggguucuccauauccuggguuuucuuccuccacacuaugacagucaaauagauuucacuaaacgguacgggaaguuuaucgacaacgccgaaccgaaaauugcguauaauaacggaaauuucaucuuuaugaacagcuucaaugagaugauugaggauuuuaagaaguaccagccccagcuguucuauaaaaaguccaacggcgaagagucuaaaaucccuuacgacuggaccauauauuacuugcgcaagaaagcucucucgcagaagauuacacaacaggaacuggccuggcugauccuccauuuuaaucagaagcgaggcuacuaucaguuaagaggggaggaggaaaccgagaacccaaauaaagaaguggcauuccacucacuggagguaguggaugucgaagccgaggcucccaacaagaaaggagagauuugguacacuaucaggcuugaaaaugguuggaucuaucggcguacaagcaagauuccuuuggacgauuggaaaggcaagacccgcgacuuuauagugacgacugaucugaacgacgacgggaccaucaaacuagauaaggagggaaaggagaaaagaaguuucagggcaccagacgagaacgauuggaaucuccugaagaaaaagacagaacacgacauugauuucuccggcaaaacuguuggugccuacaucuaugaccaucuucugcaaaaccccaaucagaagauaaaggggaaauuggugcggaccauugagcgaaaguacuauaaagaugagcucaaggcuauccuggccaaacagaucgcguuacaaccugaacuguuuacagagacccuccuugcagacugcauucgcgaacuguacagaaagaacgagacgcagcagcagaauuugcuaucuaaggauuuccugcaccucuuugucgaagacaucauuuucuaccaaaggccacugcggagcaaaaaguccacuauagccaacuguacacuugagaaacgcucauauaucgauaaggagaccaaugaaagaaaagacacuccgauuaaggugugcgcuaagaguaaccccuacuaucaggaguuuaggguacugcagugguugcagaaucuccguaucuacgaaaucgagacagaccgggagguuaccgccgaguucauugaaacggcacaagauaacgaagcucuguuuaauuucuuaaugagccagaaagagauagacaacgaaucucugcuaaaguauuuucucuucgccaaaaauccucagaucaaggauaaaguggcgaaguccgagcugaaaaaguggcuuaccacauaccgauggaacuaugucuacgacgccgcagauaauucaagcaagaaauacccaaugaacgagacuggauaugaauugcagcaauaccugcagaagguggagggccuccccgcuaacuuucugaccuucgacauuacauauagacuuuggcaucuguuguacagugugaaagauaaggucgaauuugagaaagcccucaagaaguucgcucaggaauaucagcuggacgaggccucuuucguugauuccuuuaaaaauuucaagccuuacccaaacgaguauggcagcuuuucggaaaaagcaaucaagaaauuacugccccuaaugagguucgggaaucacugggacuuuaaccgcauugaugugucuacucaaaagcggaucgacgaucucauaaauggaguagccaacgacgagaucagaaccauuaucagggaaaaggcugagaaauaccagcuuaauuccgaaacauguuuccagggucugccguuguggcuggcgcaauacguggucuauaaccgccacgcagaggccgcugacauugagaaguggaccucagugaaugaucucgaagccuaccuggaggacuuuaaacagcauaguuuacgaaacccuaucguugaacaggugauaacugagacgcugcgggucgugcgugauauuuggcagagauauggcgggggacaagcaaauuucuuugacgagauccacauugaacuuggcagggaguugaagaaaacagccgaagaacgcaagcagcucagcaaccggaaucaggaaaacgagaauaccaaccugagaaucaagaaacuacuggcugagcucaaggaagaugccuccauacagaacguaaggcccuacucuccaguucaacaggagcugcuuaaaaucuaugaagaggguguguucagcgcaacugacgaagucgaggaggauauucagaagauccgcaaaaaggcggaaccuaccacacccgagauucagcgauacaaauuguggcuggaacaaaaguauaagucaccauacaccggggaggugaucaguuuaacuaaacucuuuacagaagaguacgagauagaacauauuaucccccagucccgguauuacgacgauagccugucuaauaaggucaucugcgagucagcugugaacaaacuuaagacgaaucagcugggcuuggaguucauucaaaaccaccauggagaaaaaguuagaaucaccgccaauaaggaggugacuauuuuuacagaggaacaguauaaggaguucgucaaaaagcacuacgcaaacaauagugccaaacagcagaagcuccugcuaaacgaaauaccugagaaaaugguagcuaggcaacugaaugacacccguuauaucagcaaguacauuuccgaaauccucucuaagauugugcgcucggaugagaaagacgaaggcguuaacagcaagaauaucauaccauguacagggaaaaucacuaccgcccugaagcaggauuggggacuuaacgacguguggaaugaguugauucugccgcgguucgaaagaaugaaccaguuaacgcagacccaacucuuuacauccuauaaugacagguuccagaaaaaccugcccacugucccuaucgaguacucacaggguuuucagaagaagcgaauugaucaccggcaucacgcaauggacgcucuugugaucgccugcgcgacccgcgaacauauaaacuacaugaauaaccaacacgcccuggauaaaaguaaggacaaaaaggagaaacagcagucuagaauugaucuaaggacaauccucugugagaagaagaauaacaauuggcaguucaaaaagccauggagcacuuuuacccaagaagcucaggaggcacuggaacacaucguaguguccuucaaacagaacuugcggguuauuaauaaggccacgaacuauuacgagaaaugggaagagaagaauggcguccuggugaaaaagaaggugaaacaagaggggacaaacugggcuauacgaaagcccuuacauaaagaaaccgucucaggaaagaucguucucgacagaaaaauuggcaaggauaagauccugacugccacacgcaaaagcguggacauuaccuuuacugagaagaucauaucuuccaucaccgauacagguauucagaaaauccuucugaauuauuugaaguacaaagggaguccugaaguggcauucagcgcggagggccucgaggaacugaacaagaauauugcccaguauaacgacggaaagaaacaccagccaaucuacaagguaaggauauuugaggaaggcucuaaauucccccuaggggagacgggagcuaaggccaccaaauaugucgaagcagcuaaggguacuaaucuguuuuucggcguguaccaagggaagggaaaacguacauacgccaccauuccgcuuaacgagguuaucgagcggcagaagcagggccucccuuccgugccagaaagaaaugagaaaggugaaccccuguuguucucacugaguccuaacgauuuagucuaugugcccauggagggggaaaucgcagagacaauugacuuuaacaaucucagcaaggagcagaaagaaaggaucuacaagacuguuucguucaccggcaaccaaugcuuuuucgugcaggaggccguagcuacgccaauagucaauaaaauugaauauuccccucugaacaagauggagcgcgacauccuuggaacaaugauuaaggaaguguguaucaaacugaagguggaucgauugggcaauauaaccaaagcguga

SEQ ID NO: 3378 - RNA, 4353 nt, Artificial Sequence
  Cas9 variant
augaagagaauccugggccucgaccuugggagcaacuccauuggaugggccuucguggagcaggauuuugaaaauaaacaagguaagauaaucgcuaccggcucuaggauuauccccauggaccaggggauucugggagauuucgagaaaggcaacacagucucacagacugcagaacggacgaccuaccgcaguaugcgacguuugagagagaggcacuuacugcggcgcgaaagacuacauaggguucuccacauccuggguuuucuuccuccacauuaugacgcccagauagauuucacaaagcgguacgggaaauuuaucgacaaugcggagccgaagauugcuuauaacaauggaaacuucaucuuuaugaauagcuucaacgagaugauugaagauuuuaagaaauaccaaccccagcuguucuauaagaaauccaauggcgaggaaucuaagaucccuuacgacuggacuauauauuacuugcgcaaaaaggugcucucgcagaagauuacccagcaagagcuggccuggcugauccuccacuuuaaccagaaacgaggcuacuaucaguuaagaggggaggaagagacagaaaauccaaacaaggagguagcauuccauucacugaaaguggucgauguggaagccgaggcucccaauaagaaaggagagauuugguacaccaucaggcuugaaaacgguuggaucuaucggcguacuagcaagauuccuuuggacgauuggaaaggcaagacacgcgacuuuauaguuaccacggaucugaaugacgacgggacuaucaagguggauaaagagggaaaggagaaaagaaguuucagggcaccagacgagaacgauuggaaccuacucaagaaaaagaccgaacacgacauugauuucuccggcaagacagucggugccuacaucuaugaccaucugcuucagaaucccaaccagaaaauaaaggggaaacuggugcggacuauugagcgaaaguacuauaaagaugaguugaaggcuauccucgccaagcaaaucgcgcugcagccugaauuauuuaccgagacacugcucgcagacugcauucgcgaacuuuacagaaagaaugagacccaacagcagaaccuguugucuaaggauuuccuacaccuguuuguagaagacaucauuuucuaccagaggccacuccggagcaaaaaguccacgauagccaauuguacucuggagaaacgcucauauaucgauaaggagacaaacgaaagaaaggacaccuuuauuaaaguuugcgcuaagaguaauccguacuaucaagaguucagggugcuucaguggcugcagaacuugcguaucuacgaaaucgagacugaccgggaggucacagccgaauuuauugagaccgcagaagauuaugaggcucucuucaauuuucugaugagccagaaagaaauagacaacgagggauuacugaaguacuuccuauuugccaaaaauccccaaaucaaggauaaaguggcgaagucugagcucaagaaauggcugacgaccuaucgauggaacuacguguacgacgccgcagauaauuccucaaagaaauauccuaugaacgaaacaggcuacgaccuucagagauauuugcagaaggucgagggccugccagcuaauuuccucacuuuugauauuaccuacaggcuguggcaccuucuguauagcguuaaagacaagguggaguucgaaaaggccuugaaaaaguucgcucaggaauaccaacucgaugaggccaguuuuguagacucuuucaaaaacuuuaagcccuauccuaacgaguacggguccuucagcgaaaaagcaaucaagaagcuguuaccacugaugcgcuuuggaaaucauugggauuucaaccggauugacgugucgacacagaaaagaaucgaugaccuaauaaauggugucgccaacgacgagaucaggacuauuauccgcgaaaaggcugagaaauaccagcucaauucugaauccuguuuucagggccugccccuuugguuggcgcaauaugugguuuacaaccgacacgcagaggccaccgauauugagaaguggacaucagugagugaccuggaaaccuaucucgaggauuucaaacagcacagccugcggaauccgaucgucgaacaggugguaacugagacguuacguguugugagagacauauggcaacaguacgggggaggccaggcuaacuuuuucgaugagauucauaucgaacuggguagggagcuuaagaagacagccgaagaacgcaaacaguuguccaaucggaaccaagaaaaugagaacaccaaucucagaauuaagaaacugcuagcagagcugaaggaagacgccucuauccagaacgucaggccuuauagccccgugcagcaggagcuccugaaaauauacgaagagggggucuuuucaaguacugaucaaguggaagaggacauccagaagauucgcaaaaaggcugagccaaccacaccugaaauccagcgauauaaacuuugguuggagcagaaauacaagucccccuacaccggcgaaguuauuagccugacuaaauuauucacagaggaauaugagaucgagcacauaauuccacaaucucgguacuaugaugacucacucaguaauaaggugaucugcgaaagcgccguaaacaaacugaagacgaaccagcuuggacuggaguuuauccagaaucaucacggcgaaaaggucagaauuaccgggaacaaagaggugacuaucuucacagaggaacaauacaaggaguucguuaaaaagcauuaugcaaauaacuccgcgaaacagcagaaguugcuccugaaugaaauucccgagaagaugguggcuaggcagcuaaacgauacccguuacauaucuaaauauaucucggaaauucugagcaagaucguccgcuccgacgagaaagaugagggaguaaauucaaagaacgugauuccuuguacagguaaaaucacuaccgcccucaagcaagacuggggccugaaugacguguggaacgaacuuauauugccacgguuugagagaaugaaucagcugacgcagacccaguuauucacaaguuacaacgauagguuucaaaagaaucucccgacuguucccaucgaauacucucagggguuccagaaaaagcgaauugaccaccggcaccaugcaauggaugcccuggucaucgcuugcgccacccgcgagcacauuaacuauaugaauaaccagcaugcacuugacaaaaacaaggauaaaaaggaaaagcaacagagcagaaucgaccugaggacaauacuaugugagaaaaagaauaacaauuggcaguuuaaaaagccuugguccacuuucacccaggagacgaaagaagcucucgagcacauuguggugucauuuaagcaaaaccugcgggucaucaauaaagccacaaacuacuaugaaaagugggaggaaaagaauggaguuuuggugaaaaagaaagugaagcaggagggcaccaacugggcgauccgaaaaccacugcacaaggagacuguaagcgguaagauugucuuagauagaaaaauagggaaggacaaaauccucacagccacccgcaaggaaguggauauuacuuucaccgagaaaaucauuucuuccaucacagacacgggcauacagaagauccugcuuaauuaccugaacuauaagggaagucccgaaguugcuuuuagcgcagagggcuuggaggaacucaauaaaaacauugcccaauacaaugaugggaagaaacaucagccuaucuauaaggugaggauuuucgaggaaggaucuaaauuuccacugggugagaccggcgcuaaggccacuaaguucgucgaagcagcgaaagggacaaaccuauucuuuggaguguaccagggcaaggagaaacguuccuacgccaccaucccccugaaugagguuauagaacggcagaagcaaggucuuccgucagugccugagagaaacgaaaaaggggagccacuccuguucaguuugagccccaaugaccugguauaugucccuauggaaggcgagauugcugagacaaucgacuuuaacaacuuaucgaaggaacagaaagagaggaucuacaagacuguguccuucaccggaaaucagugcuuuuucgugcaggaagccgucgcaacgcccauuguuaacaagauggaguauucuccacucaauaaaauggaacgcgauauccugggcacaaugauaaaggagguguguauuaaacuuaagguagaccgacuggggaacaucaccaaagcuuga

SEQ ID NO: 3379 - RNA, 4353 nt, Artificial Sequence
  Cas9 variant
augaagcacauccugggccucgaccuugggagcaacuccauuggaugggccuucgugcagcaagauuuugagaauaaacaggguaagauaaucgcugcaggcucuagaauuauccccauggaccagaaaaugcugucaaacuucgaagaggggaccacagucagucagacugccgaaaggacgaccuaccggagcaugcgccgauugcgugagagacauuuacugaggcgggaacgccuacacagaguucuccauauucugggauuucuuccuccacacuaugaugcgcaaaucgacuucacaaagagguacggcaaauuuauagauaaugcugagccgaagaucgccuauaacaaugguaacuucauuuuuaugaacuccuucaaugagaugaucgaagacuuuaaggagcaucagccccagcuguucuacaaaaagucuaauggggaagagucgaaaauuccuuaugauuggacuaucuacuauuugcggaagaaagcacucucacagaagauaacccaacaggagcuggccuggcugauucuccacuuuaaccagaagcgcggauacuaccaguuacgaggcgaagaggaaacagagaauccaaacaaagaaguggcuuuccacagccugaagguaguggacgucgaggcagaggcccccaauaaaaagggcgaaaucugguauaccauuagacuugagaacggguggaucuacaggcggacuagcaaaaucccuuuggaugacuggaagggaaaaacacgugauuuuauugugaccacggaccugaaugaugacgguacuauaaagcuagacaaggaaggcaaagagaagcgcuccuucagagcuccagaugaaaacgacuggaaccuccugaaaaagaaaaccgagcaugauaucgacuucucugggaagcccguuggaacauauauuuacgaucaccuucugcaaaauccuaaccagaagaucaaaggcaaguuggugaggacuauagagcggaaauauuacaaggacgaacucaaagccauucuggcgaagcagaucgcauuacaaccagagcuguuuaccgaaacacuccuugccgauugcauccgagagcuguaucgcaagaaugaaacccagcagcagaacuugcuaagcaaagacuuccugcaucucuuugucgaggauauuaucuucuaccaaagaccgcugagguccaagaaaucaacgauugcuaauuguacucuugagaagcggaguuacauagacaaagaaacaaacgagcgcaaggauacccccaucaaggugugcagcaaaucuaauccuuauuaccaggaauuuagaguacugcagugguugcagaaccucaggauuuaugagaucgagacugaccgugaaguuacagccgaguucaucgaaaccgcacaagacuacgaggcucuguuuaauuucuuaaugucccagaaggaaauugauaacgagucacugcuaaaauauuuucucuucgccaagaauccacagauaaaagacaagacggcgaaaaucgagcugaagaaguggauuaccacauaccgguggaacuauguguacgaugucgccgacaauagcaguaaaaaguaccccaugaacgaaacugguuaugaucuucagcgauacaugcaaaaaguggagggguugccuaccaauuuucugacauucgacacuaccuauagacucuggcaucugcuuuacucugugaaggauaaagucgaauuugagaaggcacugaagaaauucgcuaagaaaaagcaguuggacaaaacauccuucguugauagcuuuaagaacuucaagccauaucccaacgaauacggaucguuuucugagaaagccaucaagaaacuccugccguuaaugagguucggcaaucacugggacuuuaaccgcauugauguguccacccagaagcggaucgacgaucugauaaauggcguagcuaacgaggacaucagaacuauuaucagggaaaaagccgagaaguaucagcuaaauucagaaacguguuuccaagaccucccucuguggcuugcacaguacguggucuacaaccgccacgccgaggcuacagauauugaaaaguggaccagugugagcgacuuggaggcguaucuggaggauuuuaaacagcacucccuccgaaaucccaucguugaacaaguggucacugagacccugcgggugguacgugacauauggcagcaguacgggggaggucaggcaaacuucuuugaugaaauucauaucgaguuaggcagagagcugaagaaaacagccgaagagaggaagcaacuuucugacaaaaaucaggaaaacgagaauaccaacuugcgcauuaagaaacuccuggcugaacuaaaggaggaugccagcauccagaauguucggccauauucacuggugcagcaagagcuccugaagauauacgaagagggggucuucaguuccacugacgaaaucgaggaagauauucagaaaaucagaaagaaaguggagccuacaacgcccgagauucagagguauaaacuuugguuggaacagaaauacaagagcccauauaccggagaggucaucucucugacuaaguuauuuacagaagaguacgaaauagagcacauuaucccccaaucacgauacuaugacgauagucucagcaacaaagugaucugcgaguccgcaguuaauaagcugaaaaccaaccagcuuggccuggaguucauucagaaccaucacggugaaaaggugcgcaucacagccaauaaagaaguaacuauuuuuaccgaggagcaauacaaggaguucgucaagaaacacuaugcuaacaauucugccaagcagcagaaauugcuccugaacgaaauaccugaaaagaugguggcacggcagcuaaaugacacgagauacaucucgaaauauauuagcgagauccuguccaagauuguuaggucagaugaaaaggacgagggggugaacaguaaaaauaucauaccauguaccggcaagaucacaacugcgcucaaacaagacuggggacugaacgaugucuggaaugagcuuauuuugccgcguuucgaacgcaugaaccagcugacccagacacaguuauuuacuucuuacaaugaccggcuccaaaagaaccugcccaccgugccuaucgaguauagccagggcuuccagaaaaagagaauugaucauaggcaccaugcuauggacgcccuuguaaucgcaugcgccacgcgagaacacauaaauuacaugaacaaucagcacgcucuggauaaguccaaagacaagaaagagaagcaacagucacggauugaucuacgcacaauccucugugaaaagaagaacaacaauuggcaguuuaaaaagccauggagaaccuucacucaggaggccaaggaggcacuggaacauaucgugguuagcuuuaaacaaaacuugagggucauuaauaaggcuacaaacuacuaugagaaaugggaagagaagaauggggugcuggugaaaaagaaggucaaacaggaaggaaccaacugggccauacggaagcccuuacacgaggagacuuucucugguaaaaucucccucaaucgagaaaagguuggcaaagggaacauucugaccgcgacaagaaaggccguggacaguagcuuugaugugaagaaaaucucuaagauuacggacaccggaauccagaaaauacuucugaauuacuugaaguauaaaggcuccccugagguagcuuucucagcagaaggucucgaggagcugaacaagaauaucgcccaauacaacaaugggaagaaacaucagccaauuuauaagguccgcaucuacgaaaaaggcaguggaagguuugugcuaggcgagaaggggacuaaaagcaagaaauauguucagggagcucccaaccuguacuucgguguguaccagggcaaggaaaagcguacauaugccaccauuccgcuuaaugaggucaucgaacggcaaaaacaggggcucccuucggugccagagagaaacgagaagggagaaccccuguuguuuucccugucuccuaaugauuuaguuuacgugcccauggagggcgaagcaacagagacuauaaacuucaacaaucucaacaaagaacagaaggagaggauuuauaaaaccguaaguuucacggguaaucagugcuuuuucguccaagaggcgguggccucaccaaucgugaacaagauggaauacaguccucugaauaagauggagcgcuccaucgucgggauuaugaucaaagaaguuuguauaaaacuuaagguggaccgacugggcaacauuacaaaggcuuga

SEQ ID NO: 3380 - RNA, 4362 nt, Artificial Sequence
  Cas9 variant
augaagaccgugcugggccucgaccuugggacaaacagcaucggaugggcccugauucagcacgauuucgacuccaaaaagggugagauauugggcauggggucuagaaucauucccaugucacaagauaucuuaggagaauuuggcaaagguaauagugucagccagacugcugacaggacgaaguuccgguccgcacgccgacugcgugagagacaucuacucaggcgggaacgccugcacagaguucuuaacauucugggguuuuugccuaggcauuacgccgcggauaucgacuucgagaaacggcucggacaguuuuucgaaggcaaggagccaaagcuggcuuaugauaauaaccaguuuauauucaccaaaucuuuuggcaagaugcuggccgacuuccgccaacaccagccggauuuucucaaagacgagaagucgaaugauuuacugauccccuacgacuggucaauuuauuaccuucgaaaagaagcauugacaaagaagaucgagaaagaagaacuggccuggauuauccuaaacuucaaucagaagagaggguauuaccagcucaggggagaggaagaggaagagaaccugaauaaacuuguggaauuucauagccugaagauaauugauguaguggcugacgagaaauugaacaauaagggugagacuugguauagucuccuguuagaaaacggcuggaccuaccggcguuccucuaaagucccucuguucgacuggaaggagaaggugcgcgauuucaucguuacaaccgacauuaaugaugacgggagcgugaaaacugauaaggaaggaaacgagaaaagauccuuuagggcaccaucagacgaugacuggacacuccuuaagaaaaagaccgaacaagauaucgacaagagucggaaacccaucggcgccuacauuuaugaugcuauacugaagaauccuaaacagaagaucaacgguaaauugguccgaacgguggagcgcaaguucuacaaggaggaacuaaaacugauucuccagaagcagaaagaguuucacccagaacugcaaagcacugaccuuuauaacgagugcaucagagaacuguacaagaauaacgacgcccaccaguugcagcucaauaaaaaggauuucguacaucuguuuuuagaggacauaauuuucuaucaaaggccccugcggucucagaaguccucaguugggaacuguccucuagaguuucgcaaauucaaggauagcgaaggaaucgagaaaguggaauaccucaagaccaucccaaaaaguaauccguauuuucaggaguucagaauuuggcaguggauguacaaccugucuaucuacaagaaagacgaugacgagaaugucacaagggauuuucuuaagacuauugaagacugggaggauuuguucgaauuucugaaccaccguaaggacauagagcaagaaacccuccugaaauuccuucugggcaagaauggcgugaaagggaaggcguugaaaguggaggcaggaaaguuccgguggaacuaugucuccgauaagaucuaccccugcaaugagacaaaagcccucauuaucagcaagcuggaaaaaguuaaggguguggaggaaaaauuuuuaaccgaggaaaucgaguauaagcuguggcaucuaauuuacucgguaacggacaagguggaguaugaaaaagcucucaaggccuucgcaggcaaacagaagcuggaucuugucucuuuuguggacuccuucaaacgauuuccuccauucaagaacgaguacggggcuuauucagaaaaggccaucaaaaagauauugccccugcucagaacuggaaaaaguuggaauuggauggcgauugacagcaagguuagggaucgcaucaacaaaauuaucacaggcgaguuugacgaagagauaaagaauaaagugcgggagaaggccgaaaagcacucccugaaaaaggagaacgauuuccaggguuuaccucuguggcuugcacaguacgucguguacgggagacacucugaagcuagcuuuucaggcaaauggaacaguguagacgauuugaagaaauaucucgaggaguucaagcaacauucccugaggaauccaaucguugaacaggugcuaaccgagacucugcgcgucguggccgacauuuggcaguuuuacggaaagggcgaaaaagauuucuuuagcgagauccacauugaacucgggcgagagaugaagaacacagcugaggaccggaaagaaaugucugccaucauacaggcaaaugagaccacgaaccugcguauuaaggcccuuuugaaugaacuguuacaagauaaaaaggucgagaacgugagacccuauucaccgagucagcaggaaauccucaagauuuacgaggacggaguucugagcuccgauaucgagauaccugacgauauccagaaaauuucuaaggcugcgcaacccaccaaaucggaacuucagagguauaagcugugguuggagcagaaauaccgcagcccauauacaggugcaaugaucccucucggcaagcuguucacuuccgaauacgagauugaacauaucauaccccaaucacuauacuucgacgacaguuuuucuaauaaggugauuugugagagcgccguaaacaaacugaaggauucccggcucgggauggaguucaucaaagaaugccacggaauggucguggagaccggcuuugguaagucaguuacaguguucgaagaggagacuuauagagacuuugucgugcagaauuacagcaaaaaccauucuaagaaguccaaacugcuuuuggaagagaucccagaaaagaugauugagaggcagaugaaugauacccgauauaucaguaaauucauuagcucuguacuguccaacauagugcgcgaagagguuaaugacgauggggucaacucaaagaauaucgugcccggcaacggaaaaauuacaacccaguuaaagcaagacuggggccucaacgauaucuggaaugagcugauucuuccucgguuugaaagacugaacgugcuaacugacaguaaacacuucacggcuuggagcgagaaucaccagaggcuccugccaacagucccgaucggguugucgaagggauuuuccaagaaacguauagaucaucgccaccaugcccuggacgcauuaguuaucgccugugcuucucggaaccacauuaauuuccucaacaaugcccacgcaaucgauaagaaaaagaacagcgaagagaaacagaaguuuagacaugaccugaaggcgauucuuugcgacaaaaaguacucagauaaaagugaaaagaauuauagguggaucuucaaaaagcccugggacaacuucaccauagauuccaagaaugcucuggacaaaauuaucgugucuuuuaagcagaacuugcgaaucauuaauaaagccacuaaccgguacgagaaguggguggaucgcgacgguauaaaaguaaaggaguggcacaagcaagaaggcaucaauugggcaaccagaaaaccucuccauaaggauacagucagcgggaaaguggaccugaagaggguuaccgugccagagggaaaaauucuaacugccacacggaagucccuggauacgucauucgaccuuaaagucaucgaaagcauuaccgauacuggcauccagaagauacucaagaacuaucugacaaguaaaucuaacaaucccgaguuggcuuuuuccagcgaagguguggaggacaugaacaagaauauccgaaaauacaacgaugggaagcugcaccagccuauuuacaaaguuagaaucuucgaguuaggcucgaaguuuccacucggacaguucggcaauaagaaauuuaaguauguggaaaccgccaaagggacaaaccuguucuuugcaguauacgaggacgaaaauaagaaccgcaauuaugagacuauuccccuuaacgucgugaucgagaggcaaaaacagggacugucaucugugccgauaaagagugaaaagggccauaaacucuuguucuaccuguccccuaaugacauugucuauguuccagguagcaacgaggaauuuucuaucgaucgucuauaccgguucaccgacagcuccgauaagacggcuaauuuuaucccccugucagugaguagccuuauuuucucuuccaacaaaaaugagcagaagaaaaucgggauaucauauccuauucaagacgaguucggacucggcaguccccagagcaagaaccagaaguccaucgaugguauuaugaucaaagagaaguguguaaaagugaauauagacagacugggcagggucucuuuuuga

SEQ ID NO: 3381 - RNA, 4368 nt, Artificial Sequence
  Cas9 variant
auggccaagauccugggccucgaccuugggaccaacagcauuggaugggcuguggucgaggaucagaauaacaaaacaacucugauagacaaggguguuagaaucuucuccgaaggcgugaaaauugagaaggggaucgaaaaaucuaaggcagccgagaggacggauuuucggucagcgcgcaagauuaaauuccgacguagauugaggaagcaagaaaccuuaaaaguacugaucgagaauaacaugugcccccuaacaauagaggaauggacuaaguggaaaaaggacaagaaagaguacccuaagaauccagauuuuaucaacuggcucaaaaccgacgaacugaagaauauuaacccguauuucuuucgggauaaagcuagucgcacagagcuuccccugaugcagaccggcagagccuuguaccaccucgcacagaggcggggauuccugagcaaucgccuggaccaggguuccgauggguuuacugagcaaauccgacucgacuuaauuaagaaaaucgaaugugagacagauaagaccgaacugcuuacgucugugcagucgauaauugacacuuauucagaggaagaggauaaggacgccaaaaaguugcugaaaggagucgagaagcuaugcaaaaucaacaaugaacucccuauuaccgaguucaaggaaaagcugaucaacuaccuuaauaaagcugacaaccugggcgcagugaagaaaggcaucgccgauguuagcaagaaaauuacagagacugggugugaaaccuugggacaguauuuuuacaagcucuaucagaaucaaaguaagauaagaaaaguguacacagcuaggaccgagcauuacuaucacgaguuccugaagaucugcgaaacgcagaacauuugugaccaguuaaaacauaagcuggauaaagccaucuuuuaccagcggccacucaagucccaaaagggucuuauaggcaaaugcgucuucgagaagaacaaaacucguugugcggugucucaccccgcauaugaagaguaccgcgcccugcaguuuauuaauagcaucaagguauccgaaacaaaagacgggaagaaagauuucuugucauucgacgagagaaagaagaucuggccuaaauuuauuaggaagaguaaaccaaacuucgauuuuaaggagaucgcugaaacccuagacaaaaagggacugagccgguauuacaauuauacuggccauacaucuguuuccgguugccccaccauugcccagcucacgaacauauucggggagaauuggcaagaaacccuguuugagaaguacacaaacaaacagaauacuaagggacuuaaaaccaucgaugagguggucacagacauuuggcacgugcuguucacuuuugauaaggacgaaaagaucaucgaguucggcaaacagaaguugggccucaacgaagugcuggcuaaaaaguuuggggcaauuaaucugaaaaaggacuacgccucacugagccuaaaagcgauaaacaagauccucccuuaucugcgagagggacuuauuuacaguuaugccgucuucuuggcaaauaucgaaaacguugugggugaggagauuuggaagaaugaugaaaacaaaaaucugaucaagaaagagcuccacuuacuuauagacaacuuuaacgaaaucaagggccuggaggcuguagugaaugauuucauugccgacuuuaaaaaggaauacaacaaugcucauaaagauuaugucuuggacgagcaggauaagaagauccuccuggagaaaauugaaucuaacuacgggaagaauaaauucgaguccuuagaaccagacaagaaaaccgagaucauaaacagcacagaaaagaugguggccgagcaacugcgcaagcagagaggagaguucauuaaaccgaagaggcuagaugagaaaaucucggaauuucucauuaauaacuucaauguuaccaagaaaucuaucgcacggcuguaucaccccuccgacguggaaauauuuaagacugccucacgcaacagugagggccuuuugcugcucgguagcccuaucgucuccucuauuaagaauccaauggcuaugagagcgaugcaucagcugaggaaauuagugaacacgcugaucaaggagaauauuaucgaugaagagacaaaaauaaacauugaacuugcacgugaguugaaugacgccaacaagcgggcugccaucaaaaaguggcaggaugaacgacaaaaggcaagagaggaguacaaaaagagcaucaaagaacucuucaaggccgagugugggaaagacauugaacccucagacagugagauccugaaguacgaacuaugggaggagcagcagcacauuugcauauauaccggcaagacuaucaacauuugugauuuuaucggagcuaauccuaacuucgacauugaacacaccaucccaaaaucccugugcuuugauaauagcaacgagaaucucacacugugcgacauacaguacaacagggauguaaagcgcaauaaaauccccaccgaacuuucugacuauaacucaauuaagccgcgguuggauaaauggcugguuuucaucgacgauuacgagaaguuauauaauacuaggaaaaaggccaagggcauugaaacaaaagagcaaaaggacaaaagaaucaaggagaaacauuacuauaagcuccaccuggauuacuggaaggggaaauacaagcgcuuuauaaugguggacgucccuaguggauucaaaaacagccagauuguggauacggguaucaucaccaaguaugcaauuuccuacaugaaaucuauauuucccaaggucuauucggugaagggcaauaucguugcggaguuccgaaaaauuugggggcuucagaacgacuacgaaaagaaagaacgggugaaucauguacaccauuguaucgacgcuauuacuaucgccugcaugagcaagcagaaauaugauacacuggcaaagauauaccacgaggacgaggccggauuucacaagaucaaaaaggaaacccaauuggucuccaaaccauggacaucauucacuauggaugugcucaacauugagaaggaaaucuucguuagucaucacaccccugacaauaugaaaaagcagucuaaaaaggugguccgugagagaggcauuaucgcucccaaggugauauaugaaacggaugccaacaacaauacccugagggacaaauacgguaagaaaauuguaaaggaguacauccuacugaaagaugugaacgggaaucucaucccaauuaagggcaagcgccugacacccagcgacaucauaaacaaaguugauggaauugacuauuuuucccuuaucauuaaugauaagauccaguacuaugaguucgcaaaaucaaagaaaacuggcaagauaauuuacaagaaagaaccuaucuauuugcaaggggacaccguccggggaagccugcauuuagacacauuuuacggugcuaucgccaaggauauuaacggcaauaucauuacuaacaccaaugggaaaauagcgccaaacuaugugaucagaaaggagcucucuaaacugaaggaaacggacauugagaauaucguggauccggucguuaggggaaagaucauugaagccaaaaagaacaaacuuauaacauucaauaaguccggcgcugugaucaaaaccacuauuuggaugaaggagaaccagauccccauuaauaaagugcgaguauacaguagccugaagaacccucuaccagacuuuaagaaacaccgcgaucucucucaccugacauacaagcagcaguauaaugucuccaacgaggaaaacuacuguuuggcaaucuaugaggguaaaaauaagaaagggaacgugugccggaccugugaacugguuaauaugauagacgccggcaacuacuauagauuaucaaauaagaacuggaagcaacaguaccccaucgugccugagaaagauagugucacuaauuauagccucaagaccauuaucacaaaaggacugauggugcuucuguacgaaaagucgccagaggagauuugggaauugacguacaaccagcagauggagaggcucuaugaaaucacccaacuggacacugagaaauccgcugagauaaagcuacuguuccaucaggaagcccgugagaagaaaguuauuacagaauacaugggccuuaagaccgggaugaaaggaggcaagaauaucgguaaacacaaggaguuucccuggauuaagguggggccgaacucuuucgaugcacucaucgaaggaauagacuuuaaacugacaccuacuggcaagaucauuaaauuguga

SEQ ID NO: 3382 - RNA, 4374 nt, Artificial Sequence
  Cas9 variant
augaagaccauccugggccucgaccuugggacaaacagcauuggaugggccaaaguguccgucgaugacuacgguaauuaucugcacgauauaaaguugggcucuagaaucauucccaugucacaggacguuuuagggaacuucgauaguggagugacuguaagccaaacggcucagaggaccgaguuucgguccaaacgccgacuggugcagcguaaucuacagagaagggaacggcuccaucgcguccugcacgugcuugacuuccugccugcacauuacgaugccgcgaucggcugggacagaacagaggcuguuacuuaugguaaguuuuugaaccacgccgaaccaaaacucgcaugggaggaacuggggaauggaaagaggcgguuccuguuuauggauucuuuccaugagaugguggccgacuuugcucgcugccaaccggcacucgucgccgauggcaagaaaauucccuuagacuggaccaucuacuaucugcgaaagaaagcucuuacacaggccauaaccaaggaggaauuggcguggauccugcuaaacuucaaucagaaaagaggcuacuaucagcucaggggagaggaagaggaggaaaacccuacuaagcaagaggaauacuacgagcugaaggugguaucgguugaagcaacagauucacggaaagggaaugacaccugguauaacgugcaccuugagaaugguuggauuuaccgucgcagcaguaagaucucccuggacgauugggucggcaaagugaagcaguuuauugugacgacugaguaugaaaaagacggggccaccuugaagacagauaaagagggauacgucaagagaucuuucagggcuccaaacgaaaaugacuggggccuccggaagaaacgaacugagacccuguuagaaaugagcgguaagacaguuggggccuuuaucuaugaucaucugcuccaggagcccgcagacaaaauacgcggaaacuucauuagaaccaucgagaggcacuacuauaaggcugaacuugaggccauucuggcggaacaguguaaauaccacaucgaguugcgggauaaggaaaugcuagaggccugcgcacgcgagcuguaccucaauaaccugccucaucaaagaucccuuaugaagaaagacaugacguaucuguugcucuacgaucugaucuuuuaucagaggccauuaaagaguaaaaaggcucugauugccaacugucccuacgaauauuacgaguauguggacaaagaaacuggcgagauaaagcgucagaauaucaagugcauugcuaaaucaaacccuuacuuccaagaguuccggcuauggcaguuuguacucaaucugcgacuuuucgauagaguggaagacaaggaggucacagccaacuacuugccaaccgcagacgaucacgccaggcuguuuacuuaucucaaugaccgcaaagaaaucaaccaggagacacugcuuaaggauuacuucaaacugaagaaggugaaaauaggcaaugaaaaggaguauccgauucgguggaacuacaucgaggacaaagaaaagaaauaucccuguaaugagaccagauacgaauugcucauggcucuggauagggcggggaucgagcacaagugguuagacgauaacaaucuggaauaucgccuauggcaucuccuguacagcguugaggugaaaucugaguccgaaacggcacuucgaaaguugaagaacgacgaugccuuugucaauucauuccugaaagugaagccuuuuaaaaaggaguacggagcuuauagcgaaaaagccauuaagcggcuccuggcaguaaugcguaaggguuucuuauggaacgagcaggacaucugcgaugaaaccagaaaaaggauugagauaaucauuaagggcgacguugaugagaaagugaaggaacgcauggggcacgccgcuuacaguuuugaccgggucucugacuuccaaggacugccagaguggcuugccuguuauguggucuacggcagacauuccgaagcaauggauauccagcacugggacagccccgagagguugauggcguauaucaauaacuuuaaacaguacucgcuccgaaacccuauuguggagcagugcauacuggaaacacuacgcacuguucaugauaucuggaaggagaccggucaaauugacgaaauccacguggagcuggggcgggaaaugaagucuacauccgaggagagagcuaggcguacucagaauguacuccgcaacgaaaauaccaaccugcggauuaaaucacuuuugaucgagcugaagaaugauacagacauauguaacguccacccauauagucccaugcagcaggaaaucuuaagaauuuacgaggaaggcgcccuccaagagcugaauagggaggaugaagacuucgaggaaaucagcaaaauuucccagaugucucagccgagcggaaaggagcuuaaccgauacaaacugugguuggaacagaaguaucggucaccuuacaccggcaaggcaaucagucucgccaaacuguuuacucccgcuuaucaaauagagcaugugauuccacagucccgcuacuucgaugacagcuucacgaauaagguuaucugcgaggccgaagugaacacacuaaaaucuaaucugcucggguaugaguuuauuaagaaacacggaggugaaaucauacauuguaccacucugggcgaugucagaaucuucucagagagugaguacaaggcauuugugauggaccacuaugcuaacaauaaaagcaagaaggauaaacuuuugauggaagacauuccucaggaguuccuguccaggcaaaugaacgacucucgguacaucucgaagguagugaaaaccuuacucagcaauauuguucgaauggccgaugaauccgaggcgacaucaaagagugucaucgugugcaccgggggagugacugacagacugaaaaaggauuggggccuuaacgacgucuggaacucuauaguuuacagccgcuuugaaaggcugaaucgucuaacagguacggaggccuucgggcacugggagaacaaggauggcaaacggguguuucagaccuccaugccccucgaacugcagagaggauucaggaagaaacgcauugaccaucgacaccaugcuauggaugcauuggugaucgccugcgcuucaagaaauaucguaaacuaucugaauaacgagagcgccaauaacccaaagaaacgggaagacuuaaggcgccagcucugugauaagaaucgugucauuagaaagcccugggagacuuuuacacaagacgcauacaacgcgcuggaaaaugugguugugucuuucaaaaacuauguccgggugaucaauaaggccaccaacagguacgagcacuaugaugagaauggcaaaaagcgcuuuguucagcagaaaggguccgaacuuugggcuauucgaaagccuaugcauaaggagacauacuauggacacgugaaccugagacggaaagaauugguaacucuccagaaggcccuggacgacauaccaaguaucugcgauaaaaagcuaagggacuacauuagcgcacuggucgagaaacacuucaacaagcgccaacuucucgcucauuuuaagucuaccgauuacuauuggcagaaacaguacgugaauaagguguaugucuggacguucuccgacgauaucaaaccgcugguugccaccagaaaguugcuggacacaucauucgaugcaaaaaggauugguacuaucaccgacacaggcauacagaagaucuuacggaacuaccucgaagccaaagggggaaaugcuacucuggcguuuacccccgagggcauugccgagaugaaccaaaauaucaguaaguauaacgaugguaagccucaccagccaauucuuaaagugcguaucacggaacccaugggggcaaaguaccgcguaggccagacaggaaauaaaauggcuaaguauguggaggcccaaagcggcaccaaccuguacuucgccauauacgaagacucggaggggaaacgauccuauacuacagucccuuuggaugagguggcugaaagacucaagcagaggcugucuccaguucccgagaaggacgaaaaugaugugccgcuaaaauuuuaccugagcccuaacgaccuugucuaugugccaaccgaggaggaacuccagcugcgggaguguaaguugaauaaagaccgcauuuacaagaugguuucaaguacuggaaacgaaugccauuucauccccuauuacguggcaaaugucaucuauaacaaaggcgguuuuaauaugcagaugcacagaccucaauccuga

SEQ ID NO: 3383 - RNA, 4374 nt, Artificial Sequence
  Cas9 variant
auggccaagauccugggccucgaccuugggaccaacagcauuggaugggcuauaguggagaaaaauaacuccgauuucacacugaucgacaagggugucagaauauuuucugaaggcguuaaaacugagaaggggaucgaaaggucacgggcagccgagcgcacgggauaccgaagugcgcguaaaauuaaguauagaaggaaguugcggaaauacgaaaccuuaaaggugcugagcaaaaaucgcaugugcccccuacagaucgaggauguagaggcuuggaagaaauccggcuucaaggacuauccucucauaccagaauuucugcaauggcuuagaacaaacgaucacgagaaugugaacccguacuucuuuagggacaaggccucucgggcaaaagucucgcugugggaauugggucgcgccuucuaucauaucgcucagcgaagaggguuucucucaaauaggcuggaucagagcagugagggagugcuggaggaacacaacccccagauucaaucccucaucgaggacuuagaagagacuucuaccauucugaaugaaguucgggauuacuauaucaaccuuggcuugcuggacggcgugaagggggauuucaaaaaggagcuagacgagggagagaaaaagcucaaaagccuguacaauacacuuauagcaauuaucaagaagaacgaaaaugauguccagaaauguaaggacgaaauuaucaaacgucugaacaagaaagaggacuuggguaaggugaagggcaaaaucaaggauauuucccaggccaugcucgacgggaauuuuaaaacccugggacaguacuucuauucauuauacaacaagggcaaaauacgcaaccaauauaccaguagagaggaacauuaccugcaggaguuuaucacaauuugcaagguacaggguaucaaugggauaaacgaugaagagauucucccugaaaagaaauucaccggacuugcuaaggaccuguauaaagccaucuuuuuccagaggccauuaaagagccaaaaaggccuaaucggcaaguguucuuucgagaagaauaaaucccggugcgcgauuucacaccccgauuuugaagaguaccgaauguggaacuaucugaauacgaucaaguucgggacucagagcgacaaaaagcuccgcuuucugacccaggaggaaaaacuuaagcugauuccuaaauucuacagaaagaacgauuuuaauuucgagguuuuggcaaaggaacucauagacaaaggagccacauuugguuucuacaagaguucuaggaaaaacgaguuucuguauugguucaauuacaagccaacugauaccguguccgcuugucaauuuagcgccucguugaaaaacgcaaucggcgaggacuggcagacaaaggucuucaccuauaagacgcugaacucugagaaaaaggaagugauucggacuguggauuaccgcgaccuauggcaucuccuguccgcuucaacaagugacaucuaucuuuacgaauaugccaaagagaaguuggggcuggaagauaaaagcgcgaagaccuuuuccaagaucaaacucaagaaagacuucgccucucugagccuuucagcaauuaauaagauacugcccuacaucaaagagggauugcucuacagucacgcugucuucauggccaauauugagaagguuguggaugaacacaucuggaaggacguaaaagagagaacuauuauccagaacgaaauauccaagaucauuaaaagcgauguguuugagagggaagucaucaauauuaucaacggccugauaaagaacucuaaaacagagggugagaauuaugcugaagagucaaagaacauuuucaaaaccgaauuugacaaugccaucgcaaagauuuucgagaagaacaaugauaucgaauuuaaccagccuuucuuagacgauacguaccugaaauauguggaggagcuaaagaaauuugacaaggcccguaguuuccucccaguuccgcggcuggaugaaaaagugauacaauuucuuuuggggaauaacaaggacggcauggucuacugcagcgauaagaauaaaaccaagaaacuguaucaucccuccgacaucgagauuuucaagaaaaagaucauuaaggacgaauuuggaaacgagaaaauggugcucggcucuccucugacaacuucgaucaagaauccaauggcuaugcgagcguuacaccagcugagaaaaguacuuaacaccuugauacucgaggaacagauugaugagaauacaaggauccauaucgaaauggcacgcgagcugaacgacgccaauaagcggaaagggauucaggauuaccaaaacgaaaacaagaaguucagagaggacgcuaucaaagagauuaagaaacuauauuuugaagaguguaagaaagaaguugagcccacugaagaggaugugcugagguaccagcucuggauagagcaggacaagaaggaaaucuacgagcagggaaaaagcauucgcaucuccgauauuaucgguucaaauccugccuaugacauagaacacaccgucccacgaaguaucucucaaaacaauagccugaugaacaagacacuuugcacuccccgguucaaucgugagauuaaaaagcagaaaaugccgaucgaauuguccaacuacgaggagauucugccuagaaucgaacacuggaagaaagaggcagaagauuuaacuaggcagauagagucaauuagcaagucuaucaaguccgccaguacgaaagaggcuaaggacaaaaauauccgccggagacauuaucucacacugaagagggauuaccuuaaaggcaaguaugaccgauucauuugggaggaacccaaggugggguuuaaaaacagccagauaccagauaccggaaucauuacuaaguacgcccaagcauaucugaaaucuuacuucaagcgcgucgaauccgugaaaggcgguaugguugcggaguuucggaagcagugggggauccaggaaucauacauugacgagaauggcuucaagcacuauaaagagaaggacagaaguaaacauacccaccauacaaucgaugcuauaaccaucgccuguaugacuaaggacaaauacgauguguuggcacaagccuggacaagcgaagacgagcaggauaagcagaaggcuaaaacgcucaugucggaagccaagccuuggaaaaccuuuaaggaggacauugagaaaaucgaagaggaaauucugguaucccacuucacucuagauaacgucaagaaacagucuaagaagaucgugaggguucguggcaaaaagcaauauguggcagagauagaacgcgacgucaauggaaaagcuauggccaagaaagaugcgaacgggaagauuaucuacaagcugaaugagaaaggagaaaagaucccccggcuccagcagggugacacaauuagaggcagccugcaccaggauucaaucuauggggccauuaaaaacccacuuaaucaagaggagauuaaguacgugaucaggaaagacuuggaaagucugaaggcuaacgacguagauaacauuguggacgagaccguuaagcagaaagucaaggaagcaaucgagaauaaaauauuacuccuguccucuaacgcccagcagaagaauaaacuuguggaugacguguggcugaacaaggagaagcaaguccccauuaaaaagguucgaaucuaugcuaauagcgugaaaaacccucuagaaaucaaggagcagucccuccugucaaaaagccggaaggaacauaaacagaagguguacggacaaaaugaugagaacuacgccauggcaauuuaugaauuggacggcaagcgcgaguuugagcugaucaauaacuucaauuuagcgaaacucauuaagcagaaagaagguuuuuacccacugaacaaggagaaagaaguaaaggggaagaaaguccuuuauccgauagccaagaguaauuacagagaugugguucugaaaaggggccaacagguggucuucuaugacaaggagguggaaaaccccaaagauaucucugagguuauugacuuuaagggacggaucuacaucauugagggcuuguccauacagcgaaucgugagaccuagcgggaagauugaugaauauggaguaaucaugcucaaauacuucaaggaggcucgcaaagccgacgaaauuaagaaagauaauuacaagccagacggcgucuucaagcugggugagaacaggcccacacguaaaaugaaucacucgcaguuuacugcauucguggaagggaucgacuuuaaggugcuaccuaccggaaaauucgauaagauauga

SEQ ID NO: 3384 - RNA, 4377 nt, Artificial Sequence
  Cas9 variant
augaccaagacaauccugggccucgaccuugggacuaacagcauuggaugggcccugauaaaucaggauuucgacaacaaaaagggugagaucuugggcaugggguccagaauuauccccaugacgcaagauauuaaagacgaauuuggaaagggcaauucuaucucacagaccgcugagaggacacgguuacgcggugugcgacgucugauacacagaacucuacucaggcgggaacgccugcauagaguccuuaacaucauuggguuccugccugagcacuacgcaaaucagaucgauuuugaaaagagguucggaaaguuuaagccagagagugagccgaaaauuagcuucgacggcaacgauguguuuuuguucgaaaaguccuaucaggagaugcucguugacuuuaaaauccaucaaccccagcugguaucuaauggcaagaaaauaccucacgauuggaccauuuacuaucugcggaagaaggcccucucgaaaaagaucgaaaaagaggaguuagcguggauucugcuuaacuucaaucagaagcgcggguacuaucaguugcgaggagaagaggaagaggaaacaccaaacaaacugguggaguuucauucacuaaagaucgucgaggugaaugcugacgaaccccaaaaagguaagccugagaucugguacagccucguucuggaaaacggcuggguguauagaagggccaguaagaccccacuuuucgauuggaaagacaagauucgggaguuuauagucacuacagaaaucaauaacgaugggaccgugaaaacggacaaggagggaacugagaaacguuccuuccgcgcacccaagccugaagacuggacccugcagaagaaaaagacagaguucgaauugucuaaaagcggcaaugagguaggugccuuuauuuacgaauccauccuccagaagccaaaccagaaaauaagagggaagcugauuucaacuaucgagaggaaguucuacaaagaggaauuaaagaccauccugaaaacacaacucuuuuuccacaaggagcuuaaagaugaaaagcuguauaacgcuugcauugaggaguuguacaagaauaacgaagcacaccggagucuacugagcaauaaaggauuugagcaucucuucaucaacgacauucuguuuuaucagcgaccgcuucgcucuaagaaaucccagauaucaaauuguccccuggaaaagagaaccuacaaaaaggagggcaucgaaauuacggagggcaucaaaguuaucagcaagaguaacccuauuuaucaagaguucagguuguggcaguggauaucuaaucucucccuguacugcaucgaaccaacugagacaaacgugaccagcacauuuuuaaauucgauugaagauuaugagaaccuguucgaauuucuaaauaaccggaaggagaucgagcagaaacaccuccugaaguaccuuuuggaaaaucagggguucaaaggaaagcugcucacuaacgagcuggaaaaauuucgcuggaauuucgucgccgacaagaaguaccccuguaacgagaccgguucucuucugcauacgagauuguccaaagugaagaacauuucaccugauuuccucaccaaagaaaucgagcaccaacuguggcacauaaucuauagugugacagacaagauugaguacgaacaggcuuuaaaaacuuuugccaggaagaauaaccuggaugucgacagcuucuuugagcauuucaagaaaaucccacccuuugaauccaccuauggcgcguacucugagaaggcaauuaaaaagcuacucccgcugauccgucuugggaaauauuggaauugggaggccauagauagcauuucaaaggaccggaucaguaagauuuuguccggagaauacgaugagaacaucaaaaaucgaguuagagaaaaggcugugcaccugacaagcgagaacaauuuccagggccuccaggaauggcuggccaaauauauaguauacgacaggcauucugaggguaacgacuuagggaaguggacuucagugagugaucuggagaccuaccuuaaagaauuuaagcaacacagcuugcgcaauccuaucgucgaacaggugauuacagaaacccuccggguugugaaagacaucuggauuaagcauggcaagggaacugagaacuucuuugaugaaauccacgucgagcugggcagagagaugaaaaauaacuccgaagacaggaagcgccuaacgaauacaauaaccgagaacgaaaauacuaaccugcgaauuaaagcacuccugauggagaugaugaacgauaaugacguggaaaacguacggcccuauucuccaucgcagcaggagauccuuaagaucuacgaggauggggcuuugaauagcaacauugaacuggacgaugagaucguuaaaauuuccaagaaggccgaaccuaccaaaucagaguuacaacguuauaagcucuggcuggagcagaaauacagaagucccuauacaggacaggugauaccacuuaauaagcuguucaccucugaauacgagaucgaacacgucgugccccagagcagguuuuucgacgauuccuuuucaaacaaagucauuugcgagagcgcggugaauaagcgcaaggacaaccaauugggucuccaguucaucaaaaaucauucuggcgaaaagguugagcugggguucggaaaagugguacaggucuuuacugaggaacaauaucuagauuucgugaaggagcacuacuccaaaaaccggaguaagcauaauaagcugcuccuggaagagauuccugagaaaaugaucgagagacagcuuaacgacacaagguacauaagcaaguuuguuucuuccaucuugucaaauauugugcgaagugagaaagacgaugacggccugaacagcaagaauaucuuaccagguaacgggaaaauuacgaccgaacucaagcgcgauuggggccugaacgacgucuggaaugaucuuauccugccgcgguucgagagaaugaacacuauaacaaauucggaccuauuuaccacauauaacgauaaguaccagaaacaccuccccacugugccuuucgaauauuccaagggauuucagaaaaagaggauugaccaccgucaucacgccauggaugcacugguaaucgcuugugccacccgcgaccauuugaaucugaugaacaaucaaucugcuaaaagcgaguuaaagcgguacgaucuccagaacaaacugagaaagaaggaaccauauuucaaucagaaagagaacaagcagaaagaggccuuuaaggacuucaucaaacccuggggcacguuuaccgaagauucaaagaaugcacuugagaagauuauaaucaguuucaaacaaaaccugagggugauuaauaaggccacaaacuccuacgaaucuuauaaagacgaggacgggaauuugcgaaucggaaaggaugguaaaccugagaagggccucauuaagcagaaagggcugaacugggcuauccggaagccacuacacaaagacacuguuagcggacagauaaaucugucccgcaucaaacuucccaacggcaaaauucucaccgcgacaagaaagaaccuggauacuucauucgacuugaagaccaucgaaaauagcauuacggauacagguauccagaaaauacugaagaacuacuuacucaguaaagagucuccggaacuggcauuuuccccugaggggcuugaagagaugaauaacgagauugaaaaguacaauaacggcaaauuccaucacccaaucaauaaggccaggaucuaugagcugggaagcaaauuuaacgucggccaaaccgggaaucggcgagacaaguucguggaagcugccaagggaacuaacuuguuuuucgcaauuuaccaggaugagaauaaaaacagaucguaugaaacaaucccccucaaugaggugauagagcaccagaaguggcgcgccucacugccuaaagaggagcaagaaaagauuccccuagucccaguuaacaaacugaagggcaccuuuaucuucucucuuaguccuaaugaccucguguacgugcccuccaacgaugagcuggaaaggagcgcuucuauugacuuuagcaaguugaaaaaggagcagaucaaccguuuauauaaaaugguauccucaagugguagccagugcuucuuugucaagucugagguggccacuuccguugugaauaaaauggaauacucaagucugaacaagauggaaaagagcauagauaaucucauggucaaagaaauuuguaucaagcugaaaaucgaccggcuugggaacauuuccaaggcauga

SEQ ID NO: 3385 - RNA, 4377 nt, Artificial Sequence
  Cas9 variant
augaagaaaauccugggccucgaccuugggaccaacagcauuggaugggcccugauagagcaggauuucgaauccaaggcugguaaaaucucuggcgcagggucaagaauuauccccaugagucaagacauuuugggaacauuugagacuggccagagcuacucccagacggccgauaggacccacuaucggucuauccgccgauuauaccagcguacaaagcugagaagggaacggcuacaucgcucgcucaaugugcuggguuuccuuccugagcacuauaaaaacgaaauagacuuugagcaaagaaaggggcaguucuacccaaauaaggagccgaaaaucgcguauuaccccgaacaggucgcuucaaagguuaaauaucaguuucuguucaagagcagcuuuuuggagaugguggaagauuucaaaaggcggggauacaacggcgccauuccuuacgacuggacuaucuauuaccuccgcaagaaggcacuggagaaaaagauugagaaagaggaacuggccuggcucuuacugaauuuuaaccaaaagcgaggcuauuaccagcuuagaggggaagaggaagauaccaauuccaacaaaaaggaggaguucuaugaauugaaaguaucuagcguggagcagacacaugacaccuccccaucaggaacuugguacaauguccaucugcagaacgguuggguguauaggcggaagaguaaggauagccuaaaagacugggaaggccucaauaagaaauuuaucguuacaacccaccugaacgcugaugggucugagaaacuugacaaagauggaaaugugucccguucauuccgcgcacccaaggaagacgacuggggccuggucaagaaaagaacggagagcguguuggagaagaguggucuccacguaggggaauuuauauacgagucucuguuagaaaacccugagcaaaagauuaggggaucccugaucaagacuauugaacggaaauacuauaagaaggagcucgaggccauccuugauaaacagaccagcuuccaccgagaacugcgcaaugacgcuuuguacaaggaggccacacuagaacuguaucccaaaaacucggcgcauagaucuaacaucaagcagaggggcuucaaauaccucuuuauugaggauauaaucuucuaucaacggccacugaagucccagaagcaccuuauugcacauugccaguacgagaaacgcacuuauaagaauaacggcggggaaaccaucgagguuucacugcagggagccccuaaaagucacccaaguuuucaagaguucagaauauggcaguuuauuuccaauuugagguucuacgacaaggaagaaaucguggagggucaggaggucucuaucacagaaaaacucuuaaagagcgauucagacuuugcugagcuguaccacuggcugagucaucagcgugaaguggaucaaaacaaaacccuaaaguauuucacgcagaagaaacucauuccgaagcagaaaaaggacaaucccacuauccgguggaacuuuccugaggauaaaaaguacgaaaugggcgaguucaaggcccagcugcuuucccgauuggagaaagugagaaauugucaaccagacaaguuucugacacagaaaaacgaacucgaucuguggcacauuauauauagcgucaccgacaagacugaguucgaaaaagcacuuguuacauuugcugagaagagggaacuggacucugagucauucguggagaauuucaagaaauuucccccuuucaagaacgauuacgccaguuauagcuugaaagcgaucaagaaaauucucccacugaugcgccgggggaaguacuggaaggccgaaaauuuaggaccccagacccugcagagaaucgagaaaaucguaaacggcgaagcagacgauaagauuuccauaagggcucgcaaacuagcccuccaucugaaugacacgaagucuuuucaaggucuuccgaccucguuggcuugcuauguggccuacaaccgacacagcgagaaugaggaaaaccagaaauggcagacaccuuccgauaucgacaaguaccugaaagauuucaagcaacauucacuccggaaccccauugucgagcagcugaucacugaagcauuacgugugguuagagacauuuggaagcacuaugggcagggccagaaagacuuuuucgaugagauccacguggaacugggaagggagaugaagaauccagccauaaaacgcaagaaacuuagucaaaagauccaggagaacgaaaauaccaacuaccggauuaaggaggucuugagaaaucucaaagaaaacaauaucgaugcuaagccuuauucucccagccaucaggagauucugaaaaucuacgaagagggcguguaucaguccauagagaacguagaagacgagauugaaaagaucaggaaaaauaacacaccaucaagcaaggauauuaaucgauaccgccuauggcuggagcaaggguauaucucucccuacacuggagaaguuauaccucucucccagcuguuuaguaaccaguacgagaucgagcacauuaucccacggagcagauucuuugacgacucucuugcgaauaaggugauuugugaauccucagucaacgcauugaaagauaauaagaccgcccuggaguucaucacaaaccaugguaacgaaaaaguggaguuugcuggcaagaccgucgagauauuaaguagcgacaaauauacugaacacugcaagagguacuucaagcguaaucgcacgaaacucaagaaccugcuuucguaugaugugccggagggguuuauuaaucggcagcugaacgacuccagauucaucucuaaauacguuaggaauuugcucagcaacaucgugcgagaagaggaggaacgggaggccauuucaaagcacauccugacaauucccggaaguauaaccucccaacuaaaacaggauuggggccugaaugaaaaguggaacgagguagucacucaucgcuucgaaagacucaauaaccugaccgguacaaccgacuuuggguucugggauaauaagaucaacgcauuuaggauuacugugccuaaagagcuuucuaagggcuucaauaaaaagcggaucgaccaccgacaucacacauuggaugcccugguuauugcugccuguacgaaagaccaugugaacuauaucaccagcuuaaauacugaaagaaacaaccacucccucgucucaaagcugcgcaauaccaaaaaggugcuuauaaacggaaaggagaggcguaucgcaaaagcguacaagcugccauggagcaguuuuccccuagaugcuaaacaccagcucgagacaacaguaauuucuuucaagcaaaaucugcgggugaucaacaaauccagcaauaagacuuggcaguggagaaacguuaauggcgaacagaagaaaaaguugauuccucagaccaaaggggacucgugggccaucaggaagucaaugcauaaagcaacggucucugccaagguggagagugugggaaaggguaaaauaaagaccacaaaccgcacuccacugggcgaaauuaaaggggagaagcacgucgagaaaaucuaugaugcucgaaucagagaaguuauuauacccaaucauuuaaacaaguaccucgacgagaagggaaaaccgaauuacgaagccgcauuuucccaaagcggcaucaagcagcugaacgagaauauugaagugcuuaacgaggguaaaccucacgcuccaaucuauaaggugccccuguucgagguagggucuaaauuuccugucagcgaagacgccaagucccccaaaaaucagaaguacguggaggcggauaagggcaccaacuuguucuuugccguuuauuggaaugaagagaaacagaagcggaacuucgaaacagugccacuccaucaagucauugugcaccagaaacagguugcuucacugccuacugagcagaggaccagugugcccaucaagccagagcuaggacuguuccuuuuuagccucucuccgaacgaccugguauacgucccuacggaagaggaaauagagaauccccacuugguggaucugaaaaacuuauccaaggaccaaacaaaucgcaucuauaagauggugucaaguaccggcaacgaaugccauuucauuccacaccauaucagccgucucauuaugaaauacaaugcaaagcagaaagucggggaguuuggaucccugaacaaggccgagaaagcuaucacuggcgaaacaauaaaggagaagugucuuaaaauucagaucaauucucuggguaaguugaaaaccgaaagaaucgccuga

SEQ ID NO: 3386 - RNA, 4380 nt, Artificial Sequence
  Cas9 variant
augaaguucaaccugggccucgacaucgggaccaauagcauuggaugggcccuugugaacgaggauuacgaaaauaaaaaggguaaaauaaucgcugcaggcuccagaauuauccccaugacacaggacauucuggauaaguuugggucuggagccaucacugagacgcaaaccgcguugaggacagacuaucggucaaaacgcaaguuaauacagcgauuccugcuacguagagaaaggcuccaccggguccugaacguucuugauuuucugccuaagcauuacgcugagaguaucgacuucgaaaaauauuuuggcaaguucuugccaaauacugagccgaaacucgccuacaaccagaaucaguuuauuuuccaaaacagcuuucuggagaugcugaaggaauuucaggagaaacaccccgaacucuuaaccaauaacaagaagaucccuuaugauuggacaauuuacuaucugcgcaaaaaggcacuuaaucagagaaucgagaaagaggaauuggccuggcugcuacuccaguuuaaccaaaagagggguuacaaucagcugcgggacgaggaagaggaauccgugccaaacaaacagguagaguucuacucucuuaagauaauugauguggucgcugaccagcccaaagaggggcgcgauaagcgaugguauucgaucaaucuggaaaacggauggaccuacagaagggagucaaagacuccuuuguuuaacugggaaggcaaaacaaaggacuucauugugaccacggaucucaaucaagacggcagcaucaaaaaggacaaagaggggaaggaaaagcggaguuuccgugcaccauccgagggagauuggacucugcugaaaaagaaaaccgagaaggaaaucuaugagucugguaaaacauuaggcacuuacauuuaugacgcccuccuuaacacccccgaucugaagauaaagggggacuuuauccgcacaauugauagaagcaucuacaaagaagaguugcagcagauaauuaauaagcaaaaagaauaucaucuagagcugaacuccucaaagcucuacaaggcuugccuggaggaacuuuacccuaaaaaugagaucuauaagagugcccugaaaaacaaggacaucgcguacuuguucauuaaugauauccucuauuaccagaggccacugaaagcaccgaaguauaacauuggaaaauguaccuacgaaagccggacguuuaagaaagaggacaagaagauacgagaguauauccccgccguugcuaaaucucacccuuuauuccaggaauuucgccuguggcaguggauuaagaaucuaaaaaucuacgagaagcucuccucagauaacugcacugacuucuuucugacaaaugaacaagauuucgagaaccuuuuugaguucuuguggaauaaaaaggaaaucgaccauaagggcauucuggaguaccucgugaaaaccaaguuuccagaccugaaacccaagcaggucaaaacuaaggugaaggaauauagauggaacuacguauaugaucacgagaaagacgaaagcaagacauacccuuguggugagaccuauuuccuucugaaaaauaaguuggauaaaauauacaacgcccaggacgauuuucucgacaaggaaaggcuguauaacuuauggcacaucauuuacaguguuacggauaagaaacaguacgagaaggcacuggcuaaauucgcccuaaagaaucaucucgacaccaaaucuuucgugaacacauuuaagcggaucccacccuucaaaaaugauuaugcgauuuacucccugaaggccaucaagaaacuuuugccgcugaugcgcgucgggaaguauuggaacuacgacgauauagacccuaucacuaaacaaaagauucagugcaucauuaccggagaggaaaaugauacaaucagcacucucgugagagagaaaaccaaccacuuuucgaaugaaaacgacuucaagaaucugcccuuauggcuggcaggcuauauaguguacaacucucauaaugaguccucagaaauugagaaguggaaaaguccacaggacaucgauacauuucuuaagaaauucaagcagcacgcuuugaggaacccuauugucgagcaaguugugaccgaaacucuccguguagugcgggacaucuggagcaaaaagggccaggggaagaaagauuucuucaaugagauacacaucgaacugggaaaggaccuaaagaaccccgucgauaaacgaagaaaacuguccucuacgaauacaaagaacgagagcaccaacacuaggauuaaggcccuccugaucgagcuuuuuacccaggguguggaaaauguuaaaccaaacucacccaagcaucaggagauuuugaaaaucuucgaagagggcgcucugaauagugggauagaaauugaggaggacaucaucaagauuuccaacacagaucaaccuaccaaaaagcaguuagaacucuauauccuguggcuugagcacaaguacaaaagcccauacacuggacagucuauuccgcugucaaaguuguuuacacccaauuaugaaauagagcauaucauuccucgcaguaaauacuaugacgauaaccucagcaauaaggugaucugugaaacggagauuaaccggcugaaaaauaaccaacuaggcuacgaguucaucaauaaccacgaaauaagagaggucacccuggaagaggguaagacuaucaggcuccuguccccagaacaguauuggaauuuugugacaaccuacuaugccaaaaacaaggcaaagcgcgagaaucuuuugcugaaagaguuacccguacagaugguugaaaagcagcucaacgacacacgauacgugucuaaauacgucaugcaacugcuuucgaagauugugcggaaagaggaugggacugacaacggcaucaauagcaccaacauucuguccaucucaggaaagaugacgcgugcccuaaagaaugauugggaccucaacgacgucuggaaugaucuguugcuguauagauucgaaagguuaaacaccauaacaaaaacuaaucucuucaccacauacagugagcagaagcagaaacgcaugccuauugugccagaccaguaugcuaagggcuuucauaaaaagcggcuggaucacagacaccaugcgcuugacgcaaucguuaucgccugcauuacuaggaaccacauaaauuacaugaacaaucaaaacauccagggggagaagcugaaaaagaaugcuauugaaaaagagaacuaucgagaaaucuugcagaagucucgccucgauauucgggcccagcugugugagaaaaaguacaaugacaacgaucccaccaaguauaauuggguguucaucaaaccgugggcagacuuuacggaaaacacaaaggauauacuagagagcaucauuccuuccuucaaacaaaaccugagaaucauuaauaagaccguaaacuacuacgagaaauauaaugaaaacggaaagaaagucaaggugaggcagaucaagggugacaauugggccauacguaaaccacuucauaaggagacuauuucaggcaaaguucaccucagcuacaagacacccgcuaaagggaagauccugaccgccacucgcaagguguuggauucuuccauggacuuuaaaaguaucgaaaagauuaccgacacaggaauccagaaaauacugaagaacuauuuagaguacaaaaagagcccugaacucgcauucucucccgagggcauugaggaacugaaugcgacgaucaccaaguauaacaaugguuuucaccauaaaccaauuuacaagguccggaucuaugaggaaggggugaaauucccucuuggcaacaagggaaauaaaaaguccaaguacguagaggcugaaaaaggcacuaaccuguuuuucgccauauacaaggaucaagagaauaacagauauuuugagacaauucccuucaaugacguguuggaaacccucaaaaaggggaugucagcaguuccagagaaaaaccaggaagagaacacacuggucuucgcccuaaguccgcaggaucugguguuugugccuacucuugacgagaucgaaaaucccgauaucgucgacuucaagaaccucaccaaagaucagacgaauaggauuuacaagaugguuagcucguccggaaagcaaugcuuuuucaucaaagcugagguggccacaucuauugugaacaagauggaauuuagcaccucaaauaaaauggagaacaguauagaagguauccagauuaaguccaauuguuggaaacugaaguuggaccgauuaggcacuaucacccggguaaucaaguga

SEQ ID NO: 3387 - RNA, 4383 nt, Artificial Sequence
  Cas9 variant
augaccaaguucaaccugggccucgacaucgggacaaauagcauuggaugggcccuugugaacgaggauugcgaaaauaaaaaggguaaaauacuggcugcaggcuccagaaucauucccaugacucaggacaucuuggauaaguuugggucuggagccgcgacggagacccaaacagcuuuaaggacugacuaccggucaaaacgcaagcugauucagcgauuccuacuccguagagaaaggcugcaccggguccuuaacguucuggacuuuuugccuaagcauuaugccgagaguaucgauuucgaaaaauaccucggcaaguuucugccaaauaccgagccgaaacugguguauaaccagaaucaguucauauuucaaaacagcuucuuugagaugcucaaggaguuccaggaaaaacaccccgaauuauuucugaauaaccagaagaucccuuacgauuggacaauuuauuaccuucgcaagaaagcauugucccagaagaucgagaaagaggaacuggccuggcuacuccugcaauucaaucagaagagagguuauaaccagcuuagggacgaggaagaggaaaauaccccagauaaacugguagaguuuuacucuuugaagauuaucaaagugacugcugacgaggcaaaggaagggauaaacaagcggugguacucgauuaaucucgagaacggauggaucuaucgccgagaaucaaaaacaccccuguucaacugggagggcaagaccaaaaauuucauugucacgacugauuuaaaccaggacggcagcaucaagaaagauaaggaagggaaggagaaaagaaguuuuagggccccuuccgagggagacuggacccugcucaagaaaaagacagaaaaagagaucuacgaaucugguaagacucuuggcaccuauauuuacgacgcucuguugaauaacccagaucuaaagauaaaaggggcccugaucaagacaauugaccggagcaucuauaaagaggaacuccaacagauaauuaauaagcagaaagaguaccauuccgagcugaacaauucaaaacuuuauaaggcgugucuggaagaguuguaccccaaaaacgaaaucuacaagaaugagcucaaaaacaaggauaucgcauaucuguucauuaaugacaucuuauacuaucaacguccucugaaagccccaaaguacaacauuggaaaaugcaguuaugagagccgcaccuuuaagaaggaagauaaaaagauaacggaguucaucccggcuguggccaaaucucacccccuauuucaggaguucagacucuggcaguggauuaagaaucugaaaaucuacgaaaaacuuacuaacgacaauuauacagacuuuuucuugaccaacgaaagggauaucgagaagcuguuugauuuccucuggaacaaaaaggagauugaccauaaaggcauacuggaauaccuuaucaagacuaaauuuccugaucugaagccaaagcagguuaaauccaaggugaaagaguaccgguggaauuauauuuacgaccacgaaaaggacgagucaaagaacuaucccuguggugaaacauacuucuugcucaagaauaagcuggauaaaaucaccagcauucaagacgacuuuuuaaacaagaaacgacuggagaaucuauggcacaucauauauagugucacggauaagaaacaguacgagaaggcacucgcuaaauucgcccugaagaaccagcuugauaccaagucuuucgugaauacauuuaaacgcaucccugcguucaagaacgacuaugccauuuacuccuugaaagcaaucaagaaacugcucccacugaugagaguagggaaguacuggaauuaugaugacauugaucccaucacuaagcagaaaauacaaugcauuaucaccggagaagagaacgacacaauuagcacuuuaguuagggaaaagaccaaucauuuuucgaacgagaaugauuucaaaaaccugucucuuugguuggcuggcuacaucguguauaauucccacaacgaaucaagugagauagagaaguggaaaagcccgcaggacaucgauacauuucucaagaaguucaaacagcaugcccugcggaacccuauugucgaacagguggugaccgagacucuacgcgucguuagagacaucuggcugaagaaaggccaagggaagaaagacuuuuucaaugaaauucacaucgagcucggaaaggaucugaagaaccccguggacaaaaggcguaagauauccucuacgaauagcaaaaacgagacaaccaauauucggaucaaggcucuuuugaaagaacuguuaaaggaggguaucgaaaacauuaagccaaauucaccuaaacagcaggagauccucaagauuuuugaagagggcauacugaacagugggaucgauauugaggaagagaucauuaaaaucucccagauagcccaacccacuaagaaacagcuucaguacuaucgaaauuggcuggaacaaaaguacaucagcccauauaccggacaguucauucccuugucuaaacucuuuacaucaaaguacgagaucgaacacauuaucccuagaaguaaguacuaugacgauagccuguccaacaaaguaauaugugagaccgagauuaauaggcuaaagaacaaucagcugggcuacgaguucaucaacaaucaugaaauccgcgaaauuacucucgaggaagguaaaacaauacggcugcuuucuccaaagcaguauuuggacuuugugacgaccuacuaugggaaaaacaaggcaaagagagagaaccuguuacucaaagagaucccgauucaaaugaucgaaaaucagcugaacgauacuagguacgucucgaaguaugugaugcagcuucugagcaaaauuguucgcaaggaggacggcacagauaauggaaccaacuccaucaauauacuaucagugaguggcaaaaucacacgaguccucaagacugacugggggcugaacgauguguggaaugacuugcugugcuaccgguucgaacguuuaaacaagauuaccaauacgaaccucuucaccacauacucugagcagaaacaaaagaucauucccaucguaccugaucaguaugccaaaggauuucacaagaaaaagcuggaccauagacaccaugcucuugacgcgauacugauugcauguaucacuaggaaucacaucaacuacaugaauaaccagaauauucagggugagaaguugaaaaacuucaagaucgauaaacacaauuaucaugaaauauuucaaaagagccgccucgacaugcgggcccagcugugcgagaaaaaguacaacgaucacgacuccaccaaauauacauggguuuucacuaagccaugggcugauuuuaccgaaaacauuaaggacacgcuagaguucaucauucccucauuuaaacagaaucugagaaucauaaacaagacagugaauuacuaugaaaaauacaacgagaauggcaagaaagucaaggugaggcaaaccaagggggauaacugggccauucgaaaaccucuucauaaggagacuaucagcggaaaaguccaccuccuguacaagacaccagcaaaaggcaagaucuugaccgccacucgcaaggugcuggacucuuccauggauuucaaaaguauugaaaagaucaccgacacagguauucagaaaauauuaaagaauuaucucaaauacaaggagagccccgaacuggcuuuuucuccggaggggaucgaggaacuuaacauuacgaucgccaaguauaaugauggcuucuaccacaaaccuaucuauaagguucggauuuacgaggaaggagugaaauuuccacugggcaacagagggaauaagaaaaacaaguauguagaggcagaaaaaggaaccaauuuguucuucgcgauauacaaggaccaggagaacaauagguacuuugaaacuauccccuucaacgacguccucgagacacugaagaaagguauguccgcugugccugagaagaaccaggaaaagaauacccuaguuuuugcccugucaccccaagaucuuguguucgucccaacacucgacgagauugaaaacccugauaucguggacuuucguaaucugacuaaggaucagaccaaccgcauuuauaaaaugguaaguagcucgggcaagcaguguuucuuuaucaaggcagagguggccacguccauaguuaauaaaauggaguucacaaccucuaacaagauggaaaauagcaucgaggggauucagaucaaaucaaacugcuggaaguugaaauuagaccggcugggaacuauuaccagagucaucaaguga

SEQ ID NO: 3388 - RNA, 4389 nt, Artificial Sequence
  Cas9 variant
augaccaagaacauccugggccucgaccuugggacaaauagcauuggaugggcccugauaaaacagaacuucgagaauaagcaaggugaaaucuugggcaugggguccagaauuauccccaugucucaggauauuuuaggagacuuuggcaaagguaacucagugagucagacugcugagaggacgaaguaccggagcguccgccgacugcgugaaagauuccuacucaggcgggagcgccugcacagaguucuuaaucuguugaacuuucucccucagcauuaugcaucccaaaucgauuucgagaaaagguuugggaaguucaagguggagaccgagccaaaacuggccuggaagaauauagacggacaguuuucuuuccuguuucagacaucguucaacgaaaugcucgaggauuuucggguaaauggccaggacgugaaaaucccguacgauuggacuauuuauuacuuacgcaagaaagcgcugucaaagaagaucgaaaaagaggagcuugcuuggauuuugcugaacuucaaucaaaagcgaggcuauuaccagcuaagaggggaagaggaagaggaaaaccccaauaaacucgucgaguuuuauagccugaaggugguugacguggucgccgaugagccucagaaaggaaaguucgacaucugguacagucuuauacuggaaaacgguuggguguacaggcgguccucuaaaauuccauuguucgauuggaaggacaagacccgugauuuuaucguaacaaccgaccucaaugacgauggcagcauuaaaaaggacaaagaugggaacgagaagcgcuccuucagagcacccucagaaaacgacuggacucugguuaaaaagaagacagagcaggaaaucgagcaaaguaggaaaaccgugggaacguauaucuacgaggccuuacuggauaauccuaagcagaaaauuaagggcaaacucguccggacuauagaacgaaaguuuuauaaggaggaacuucgccagauccuggagaaacaaaaggaguuccaccaggaguugcagagcgacgaucuauacaacgacugcgugagagagcuguauaggaauaacgaagcucaucagcucacccugucuaaaaaggauuuugugcaccuucugauggacgauuugauuuucuaccaacggccacuccgcucccagaaaucaagcgucaguaauuguacacuggaguuuagaaaguauaaggacgaaaacggugcagagcauacucaguacuuaaaagccauccccaagucuaauccuuacuaucaggaguucaggcuguggcaauggauauacaaccuaaauauuuaucgucgggaagacgagcagaacccaaucaccggggaauuucucuccacaaccaaagaguucgaaaaucuguuugaguuccuuaacacgcgaaaggagguugaucagaaggcuuugcugaagcacuuuaaacucaaugacaagacucacagauggaacuucguggaagauaagaaauacccgugcaaugagacaaagaccaugaucagcucgaggcuggaaaaaguagagaacauuucugacgauuuccuuacucgcgaaaucgagcagaagauuuggcauauaaucuauuccgugaacgacaaaauugaguacgaaaaggcccugaagucauuugcgaaaaagcaccauuuggaugagaguagcuucuuugaagcauuccggaaauuucccccuuucaaguccgaguauggaucuuuuagcgaaaaagccgucaagaagcuccugccauuaaugagacugggcaaauacuggaauuacgcugacaucgauaagucaaguaaagagaggauccaaaagauuauauccggcgaguaugacgaaaacaucaaagaucgcgugcgagaaaagagcguucaccuaacaaccgaaaaugacuuccaggggcuccagcuguggcuugcccaguacauuguguauggacggcacucugaggcaucaaugaucgguaaguggaacagugcugaugacuuggaggaauuucugaaaaauuucaagcaacauagccuccguaaccccauugucgaacaggugaucacggaaacccugagaguaguuaaagacauaugguuaaaguacggcaauggggccaaagacuuuuucaacgagauccacauugaacugggaagggagaugaaacuuccugcgaaagagcgcgaagauuugacacggaagaucacugagaaugaaaacaccaaucucagaauuaaggcccugcuagcagagaugaugaacgauuccucuguggaaaaugucaggccauuuucgcccaugcagcaagagauccugaaaauauaugaggacggcgugcucaacagcgguauugaaaucgaggaugaauaccugaagauuuccaaaacagcucagccgucaccuagugaccuuaagcgauauaaauuguggcuggagcagaaguacaagucucccuacacugggcagaucauaccauuaaauaaacucuucaccccugaauaugagaucgagcauauuaucccccaaagccgcuacuucgaugacuccuuuucaaacaagauuaucugugaaagcgccgucaacaaacugaaggauaauuauauaggccuuggauucauuaaacaguuuggcgggacaaucaucgagcugggauucgguaagucugugaagguuuuugaaaccgaggaguacgaagacuucgugaaaaagcacuaugcuaacaaucgguccaaaagaaacaaguugcuccuggaggauauuccagagaaaaugaucgaaaggcagauuaaugacacucgucauauaaguaaguacaucagcggcguacuaucuaacauuguccgcaucgaugacgaccaggccaagaaaauuaucgaagaugcagagauacuggcccggaaggagaucgacaaagauaaggcuaaugaaauuagaaggaaagcgaagucccucgcaacggacgaugggaucaacucaaagaauauugugcccggaaacggcaaaaucacaacccaacugaagcaggacuggggucuuaaugauguuuggaacgacuugauacugccucgauuugagcggaugaaucaguuaacuaacaguaaagauuucaccguguggaaugaaaaccaccagaaguaucucccaacagucccgauugaguuuagcaaaggguucucgaagaaacgcaucgaccacagacaucacgcccuggaugcucuugugaucgccugcgcaaccaaggaccauguaaaccugcuaaauaaccaauccgccaagucugacacuaaaagguacgaucucaagaaaaagcugaugaaauuugaaaaggugguuuaccaccacacacagacgggcaauaagauugagcgggagauacccaaacaguucuugaagccuugggaaaacuucaccuuugacgcuaaauauaaucuggagagcaucauugucucauucaagcaaaacuuacgagugaucaauaaagccacuaacuacuaugaaaaguacguggagaaggauggaaccaaaaauaagggcagagucgaacagacagggacaaacugggcaauucgcaaaccaaugcauaaggacacuguuaguggaaaagugaaucuccccugggugaagguaccuaaggguaaaauccugaccgcgacgaggaagauacuugauaccuccuuugaccugaaaucuaucggcagcauuacagauacugggauccagaagauuuugcguaacuaucucgaguucaaaggauccccagagcuggcuuuuucacccgaaggcaucgaggaccuaaauaagaacauagaaaaauacaaugaugguaagccgcaccagccuauuaacaagguccggguguucgagcuggggagcaaauuucaaguuggccagaccggaaauaagaaagacaaguauguggaggccgcaaaaggcacaaaccuuuucuuugccgucuacgaagauaagaacgggaagagaaguuacgagacuaucccacucaaugaagugaucgagaggcagaaacagggacugucuguuguggacuugaagggcaccaacgauuucuaucugugucccaaugacuuaguauacauuccuuccgacgaugaacucgagaacaucaauaacauagacuuuaaaaauauugcuaaggagaaaaacgaacgcaucuauaaggucgugagcuucucggguucacaaaucuuuuucgugcgacaggauauugccacgucuauagucaauaaggcagagcugaguacacuuaacaaaauggaaagagcuauggacggguccaugauuaaggagagcugcguuaaacugaauguggaucgguugggaaacaucucuaaggccuga

SEQ ID NO: 3389 - RNA, 4401 nt, Artificial Sequence
  Cas9 variant
augaccaagaacauccugggccucgaccuugggacaaauagcauuggaugggcccugauaaaacaggauuucgaaaacaagcaaggugaaaucuugggcaugggguccagaauuauccccaugucucaggacguguuaggagaguuuggcaaagguaauucagucagucagacugcugcaaggacggauuaccgcgggguucggcgacugcguaagagauuccuacucaggcgggaacgccugcacagagugcuuaacguacugaacuuuuugccugugcauuaugccagccagauugacuucgagaaaagguuuggaaaguucaaggaagauaccgagccaaaacucgcguacaauaaggagggcuuuaucuucaaaaauuccuuugaagagauggucgcugacuuccggaagcaccaaccgcagcugcuggaaaacgauaaaaagauacccuaugacuggacaaucuacuaucuccgcaagaaagccuuaucuaagaaaauugagaaggaggaacuggcauggauccuuuugaauuuuaaccagaaacgaggcuacuaucagcugagaggggaggaagaggaagagaauccuaacaagcuaguggaguucuacucgcucaaaauuacugauguucuggccgacgaaccacaaaagggaaagucagauaucugguacagccuuauacuggagaaugguuggauuuauaggcggaguuccaaaacccccuuguuugacuggaaggagaaaacacgugauuucaucgugaccacugaccucaacgacgauggcucuauuaagacagacaaagaugggaaugaaaagcgcagcuucagagcuccuuccgaaaacgacuggacccuggucaagaaaaagacggagcaggagaucgauaaaucacagaagacugugggaaccuacaucuaugaaacauuacugcagaacccaaaacaaaagauuaagggcaaacucguaugcacuauagagaggaaguuuuacaaagaggaacuuaagcagauccuggaaaaacagaaggaguuccaucaagaguugcagaaugacgaucuauauagugacuguguucacgaacuguaccggaccaacgaggcacaucagcucacacugagcaagaaagaaauugugaaucuuuuuauggaggaucugaucuucuaucagcgacccuugcgcucucaaaagaccuccauaucaaacugcacgcucgaguuuagaaaauacaaggacgaaaauggugucgagcacacucaguuccugaaagccauuccuaagagcaacccauacuaucaggaauuuaggaucuggcaguggaucuucaauuuaaacauuuacaaacgggaugacgacaguaaugugacaaaggaguuucugaacaccacugaagauuucgagaaucuauuugaguuccucaacaaucgcaaggaaguggagcaaaaagcucugcuuaagcacuuuaaauugaacgaaaagcugcauagauggaauuucgucgaggacaaaaaguauccguguaacgaaacaaagaccaugaucucuacgaggcucgauaaaguugagaacauuuccaaggacuucuuuacccgugagauagaacagaaaaucuggcacauuaucuacagcgugaaugauaagaucgaguaugaaaaagcccugaagucguucgcgauuaagcauaaccuugacgagaauagcuuuuucgaagcauuuaaaaaguuucccccuuucaaauccgaguacgggucauucagugagaaggccaucaaaaagcuguugccacucaugcggcugggaaaguauuggaacgaagaugagauauuaaaauacagcgacgauuacuuuaagaauauugaaucccugcuaggcguacucaaacagcgagacgagaacaucucugaugcugacagagagaauuauaacaagacaauuaauaacaaacugagggccgaacuugagaauuuccagaacgcagaaaucgagagcuuucaaggcuugcgccugcacauagcucaguacauccucuaugggaagcacucagaaggagauaauaaaaaguucaacagugccgacgaccuggagaaguuuuuaaaagaguucaagcagcauucccugcggaaucccauuguggaacaggucaucacugagacccuuagagugguuaaagauauuuggacaaaguacgguaacggcgcgaaagacuucuuugaugaaauccacauagaguuggggagggacaugaagaagacucgcgaugaacgagccgacgcaaccaaaauuaucacagagaacgagaauaccaaccuccggauuaaggcucugcuagccgaaaugaugaaugauguggagauggaaaacguccguccuuauagcccaaugcaacaggagauccugaaaauauacgaagacggaauccucaagucugauauugagaucgaggacgauauucugaaaaucucaaagacugcucagcccaguagcuccgaccuuaagagauauaaauuguggcuggaacaaaaguacaaaucuccguacacgggccagauaauuccuuuaaauaaacucuucacacccgaguaugaaaucgagcauaucauuccacagucgagguacuuugaugacagcuucuccaacaagaucauuugcgagucagccgugaauaagcugaaggacaacuauauaggucuuggguuuaucaaacaguucggcggaaccauuguagaauguggcuuugggaagaauguuaaaguguucgaggcagaagaguacgaagauuuugucaagaaacacuaugccaacaaucgcggaaagcggaacaagcuguugcucgaggagaucccugagaaaaugauugaaagacaaaugaaugacacuaggcauaucaguaaguacauaucuggugugcugagcaacaucguccgaguggaagauggcuccgacgaggggguuaauagcaaaaacauugugcccggaaacggcaagaucaccacacagcuaaaacaggauuggggucugaaugacguauggaacgaacucauucugccacgcuucgagcggaugaaucagcuuaccaacucaacugauuuuacagcuuggaaugagaaccaccaaaaguucuugcccacggucccuaucgaguucucuaaaggguuuuccaagaagagaauagaccacaggcaucacgcgcuggaugcauuaauuaucgccugcgcuaccaaagaccaugugaaucuccugaacaaucagagugccaagagcgauacuaaacguuaugaccuuaagaaaaagcugaugaaguucgaaaaaguuguguacaaccacccacagacaggcgaccgcaucgaacgggaggucccgaagcaguuucuaaaacccugggauaauuucaccuuugaagcaaagaacaaucucgacaaaauuauagugucuuucaagcaaaaccugagaguaaucaauaaggccacaaacuacuaugagaaauuuguggagaaggauggaguuaaaacuaaggaaagggucgagcagaaaggcaccaauugggcuauucgaaaguccuugcacgaagagacggugucagggaagaucgaccugccuuggguggagaccaacaacggagaguucauuacagccacucggaaaaguuuagaugcaucuuuuaaucucgaaaagaucaaaaagauaaccgacacagguauccagaaaauucugcgcaacuaccuuaaggcgaaagaugacaaugcugaacuggccuucucgccagagggcaucgaagauuugaacaagaauauugagaaguauaacgacgggaaaucccaucaacccaucgucagaguuaggguguacgagaagggaaaaggccgguuugcacucggucagacugggaauaacauagauaaguaugugcagggcucuccuaaucuguucuuugccauuuacaaagacgaaaacggcaaaaagagcuaugagucaauccgacuagauaucguaauugaaagaaugaagcagggacugcaagcugucccagagaccaaucccaacgggaucagucuuuaccagaaucucuccccgcuggacuugguguacauaccuacggaagacgagauugagucuccacaccugaucgauuucacaauuuuaaacaagacccgccucgaaaggaucuauaauguuaacgacuucagcggauacacuauauauuuuucccagaacucauucgccaaaaauauuuaccccaaggagauggauaugacauggaacgagaaaaagcagaagccuagcggcaguuuugacucuaaaaccgcauccuauaauaagaaaagcaucaaggauaucuucauuaaacugaagaucgaccgucuugguaacauuucgaaggugucaaauacucuguga

SEQ ID NO: 3390 - RNA, 4401 nt, Artificial Sequence
  Cas9 variant
augaagaacauccugggccucgaccuugggaccaauagcauuggaugggcccuggugaaagaggauuucgaaaacaagcagggugagauauugggcuuaggguccagaaucauucccaugucucaagacauccugggagaauuuggcagggguaauucaauuagucagacagcugaucggacuggguaccgcggaguccgacgucuaagagagaggcaccuccugcggcgcgaaagacuucauaggguucugaacaucuugggcuuccucccuaaucacuaugcaaaagagauagacuuuacgaagcggcugggcaaauucaucaaccaugccgagccaaagcugagcuuugauaaggaguucauuuuuaaagacuccuucaaugaaaugcucaaggauuuucagcagaaccaaccgggguucaucauuaauaaacacggagaagaggcguuagugcccuacgacuggaccaucuauuaccugcgcaagaaagcucuuacacagaagauagauaaggaggaauuggccuggauucugcuaaacuuuaaucagaaacgagguuauuaccagcucagaggcgaggaagaggaagagaacacuaauaagcugguagaguucuauucucuuaaaaucauugacgugaucgcagauaacgaagucaauaagaaaggggaggugugguacucgcugcauuuggaaaacggauggaucuacaggcggucaagcaagauuagucucguugacuggaaagauaaggugcgugacuuuauagucaccacagacgugaacgaugacggcuccgagaagcuggauaaagacgguguaguuaagcgcucuuucagagccccuagcgcugaugacuggaccuuacugaaaaagaaaacugaacaagauaucgacaauuccaacaagacagugggggcauauauuuacgagaaucuccuucugaacccaaagcagaaaaucaagggaaaauuggucaggaccauagagcggaaguucuauaaagaugaacuaaagcagauucuggagaagcagaaagaauuucaccaagagcuccagaaugaacagcugcuucaagacugcgugcgagagcuguacaaguauaacgagcagcaccagcagauguuggaaucaaaagauuucgugcaucucuuucugaaugacaucaucuucuaccaacgccccuuaagaagucaaaagagccugauuucuaacuguacgcuagagaaaagggucucccgggacggcguuguguuuccuaucaagguaauuucaaagagcaauccauauuaccaggaguuccgccuccugcaguggcuucaaaacuuggccauauacagaaaagaugacgaugugaaugucacucaggaauuucugaacaguaucgagucuugggaaaaucuccugcaguuccuuaacgcuaagaaagagauuaagcaggaacaacugaucaaauuuuugcucgagcagaagggccugaaaggaaauuccuuaaagaccgccauccugacauauagguggaacuacgugacugacaagguuuaucccaugaacgaaacccguagccuaauucaggauaaacucaagaaaguggagaaugucgcgacagacuuccugucguuugauaacgagauggcacuuuggcacauaaucuacucugugaaugacaagauugaauaugagaaagccuuggcuaaguucgccuccaagcauaaccuggaugaaaucucauuuguagagaguuucaaaaaguucccuccauuuaaaagcgacuacggguccuucucugaaaaggcaauuaaaaagcuccugccguuaaugcgguuugguagcguuuggaauaagaacaauaucgugcccucaguccuggaucgaauagacaaaauccuuaccggcgaguaugaugagaagauuaaaaucagagugagggaaaaggcugagcaguuccaauugaaccagauugaagacuuucagaaucucccucuguggcuagcccaauacgucguguacgaccgccacagugaggcggaaaucgccgggaaauggaacuccguuaaggaucuggagaauuaucucaaggaguucaaacagcacagccugcggaacccaauaguggaacagauuaucacggagacucuuagaguagucaaggacauuuggcagcaauacggaaauggcgugcagaacuuuuucgaugaaauccauauagaguuggguagggagaugaaaaauacagcagacgaacgcaagcgaaucaccaacucuguuacugagaacgaaaauacaaaccugcggauuaaggcuuuacucguggagcugaaagaagauaccaauaucgagaacguccguccccacucaccuaugcagcaggagauucuuaaaaucuaugaagagggggugcugaaugccguagaaaacauagacgaggauauuuugaagaucaguaagacggcucaaccaagcaaauccgaacucaucagauacaagcuguggcuagagcagaaauaucagucucccuacaccggcgagaugauuccgcugucgaggcucuuuacaagcgacuaugaaaucgagcaugugauuccucagucccgcuacuucgaugacucacugaguaauaagguuauaugcgaagccgcagucaacaaacggaaggauaaucaacuuggauuggaguuuaucaagaaccaccauucugagaaaauugaacugggcaaugggagaacugcccagguguuagagguggaagcguacgagagcuucgucaagaaaaacuaugacaagaauaggggaaaacgaaacaagcuccugcuugaagauguucccgagaagaugaucgagcgccagcugaaugacacccgguacauuuccaaauuugugacacaccuacucucaaacaucgugagaaaggacgaaguaaacagcaaagaugacgguauaaauucuaagaacaucauuccaggcaaugggaaaaucacuucccaacugaagcaggauuggggauugaacgacgucuggaaugagcugauuuuaccuagguucgaacguaugaacaaucucaccaacaguacagauuucaccagcacuaauacgaacggcaagaucauacccacagugccacuggaguauucuaaagguuuuuccaagaaacgcauugaccaccggcaucacgcucuugaugcacugguuaucgccuuggcuaccagagaccaugugaaucuccugaacaaugaaucagcccuacccaagaaagauaggacuaaggaggagcagaagaguuuccgauuugaccugcaggucaaccuucggaauaaagaaaaguacuucaacgugaaagaggggcgcgaaaaggagaaauuuaccacauucaagaaaccuuggaauacccucacucaagauacaagagacgcacuggaaaacaugguugugagcuuuaagcagaacuugaggguaaucaauaaggccacgaacuauuacgagucguauaccgacgagaauggcaaccugcgguuagauaaauacggaaauccaaagaaagaacucauuucccagaagggcacuaacugggcuauacgaaaaucucugcacaaggagacagucagcgggcagauccaccuugacagagugaaggugaccaaaggaaagauugucacagccacucgcaaaucacuggauaguuccuucaaugaaaagucuaucgagagcauuaccgacacggguauccagaaaauauugaggaacuaccucaaggcaaaggauaauaaaccggacguugcguuuucccccgaaggcaucgaggagcugaacaagucaauuagcguguauaaugaagggaaaaaccaucagccuaucauuaagguacguaucuucgagcagggaaguaaauuuccagugggcgaaaccgguaauaagauagcuaaguucgucgaggccgcaaaagggacaaaccuauucuuuggcauuuaccaggauaagacuggaaaacggucuuaugacaccaucccccugaaucuugugaucgagagacucaagcaaggccuguccccuguuccagaaacaaacgagaaagggcaccaguuguuauuccaucugagccccaacgaucucguguacgucccgacuauugacgauaaugaacagcuggacucgaacaggguguauaaguuuaccgauucaucugacacgacauguaauuucaucccuaguaacauauccgccauuaucuuuaauauuaacagcaaagagcaggaaaagcgcggaaucaauuacccaauacaaaacgagcuuggcguugguucuccccagagcaagaaucagaaauccuucgacggguuuaugauuaaggaggugugcaucaaacugaaggucgaucgauugggaaacaucucaaaaaccuga

SEQ ID NO: 3391 - RNA, 4416 nt, Artificial Sequence
  Cas9 variant
augugcaaguacuucuauaucaaaaacuuuauuaccuucgugcugagcaaguccauaauccccaugaaacacauucucggccuugaccuggggucuaauucaaucggaugggccuuuguccagcaagauuucgagaacaagcaggguaaaauuaucgcuacaggcaguagaauaaucccuauggaccaggggauuuugggagauuuugaaaggggcaauacuguuagccagacggcagagcggaccacauaccgcuccacucgacguuuaagagaaaggcaucugcuacggcgcgagagacuccacagggugcugcauauccuugguuuccugccaccgcacuaugacgcccaaauugauuuuaccaagcgguacgggaaguucaucgacaacgcggaacccaaaauagcuuauaauaacggaaauuuuauuuucaugaacucuuuuaaugagaugaucgaggauuucaagaaacaucagccucaguuguuuuacaagaaaucgaacggcgaagagucaaagauuccauaugacuggacaaucuacuaccuccgcaagaaagcccugagccagaagaucacccaacaggaacuggcauggcucauuuuacacuucaaucagaaacgaggcuauuaccagcugagaggggaggaggaaacugagaaccccaauaaggaaguagccuuccacagucuuaaaguggucgauguggaggcugaagcaccuaacaagaaaggagagauaugguauacaaucagguuggagaaugguuggauuuaccggcguaccuccaagaucccacuggacgauuggaagggcaaaacgcgcgacuuuauaguuacuaccgaucuaaacgacgacgggacaauuaagguggauaaagaaggaaaggagaaaagaucuuucagggcccccgacgaaaacgauuggaaucuccugaagaagaaaacugagcaugacaucgauuuuagcggcaagaccgucggugcuuauaucuacgaccaccuucugcaaaacccuaaucagaaaauuaaggggaaauuggugcggacaaucgaacgaaaguauuacaaggaugagcucaaagccauucuggcgaagcagauagcauuacaaccagagcuguucaccgaaacgcuccuugccgacuguauccgcgagcuguacaggaaaaacgaaacucagcagcagaauuugcuauccaaggauuuucugcaucucuucguagaggacauuaucuuuuaucaaagaccgcugcggagcaaaaagaguacaaucgcuaacugcacccuugaaaagcgcagcuacauugauaaagagacuaaugagagaaaggacgcccccauaaaaguuugugcaaagucuaacccuuauuaccaggaauuuagggugcugcagugguugcagaaucuccguaucuaugagauugaaacagaccgggaggucaccgcugaguuuaucgaaacgccacaagauugcgaggcccuguucaacuuuuuaaugucccagaaagaaauugacaauaagggacugcuaaaauacuuccucuuugcgaagaacccccagaucaaggauaaagccgcaaagucagagcugaaaaaguggcuuaccacauaucgauggaauuacguguacgacgcugccgauaacagcaguaaaaaguauccuaugaaugaaacuggcuacgaguugcagagauaucugcaaaagguggagggccucccagcuaacuuccugaccuucgacauaacauaccagcuuuggcaccuguuguauucugucaaagauaagguugaauuugagaaagcccucaagaaauucgcaaagaagaaacagcuggacaagacuuccuuuguggauagcuucaaaaacuuuaagcccuacccgaaugaauaugggucguucucugagaaagccaucaagaaguuacugccucuaaugagguuuggaaaccacugggacuucaaucgcauugauguauccacccagaaacggaucgacgaucucauuaacgguguggcuaaugaagacaucagaacaauaauuagggagaaggcggagaaauaccaacugaacucagaaaccuguuuucaggaccuucccuuguggcuggcacaguacgucguguauaaucgccaugccgaggcuacugauaucgaaaaguggacgaguguuagcgaccucgaggccuaccuggaagauuucaaacaacacuccuuacgaaacccaauuguggagcaggucgugacagagacccugcggguaguucgugacaucuggcagcaguauggcgggggacaagcaaauuucuucgaugaaauacauaucgagcuuggcagagaauugaagaaaacugccgaggagaggaagcagcucucugacaagaaccaggaaaaugagagcaccaaccugcgcauuaaaaagcuacuggcugaacucaaagaggaugccucaauccagaaugugcggccuuacagucugguccaacaggaacuuuugaagauuuaugaggaggguguguuuuccgcaacagacgaagucgaggaagauauccagaaaauaagaaagaaggcggagcccagcaaagcugaccugcagagguacaaguuauggcucgaacaaaaauauaagucuccauacaccggggaggugauuucacugacuaaacuuuucacagaggaauacgagaucgaacacaucauuccccagagucgauauuacgaugacagccuguccaacaagguuaucugcgagucugccgugaauaaguugaaaacgaaccagcucggccuggaguucauucaaaaccaucacggagagaagguacgcauaaccgcaaauaaagaggucacuaucuuuacagaagaacaguauaaggaguucgugaaaaagcacuacgccaacaauucggcuaagcagcagaaacuacugcucaacgaaauuccugagaagaugguugcccggcaacugaaugauaccagauauaucagcaaauacauuuccgaaauccuuucaaagauagugaggagugacgagaaagacgaaggcgucaacucuaagaauaucauuccauguacagggaagaucacuaccgcauugaaacaggauuggggacugaacgacguguggaauaaguuaauucucccgcguuuugagcgcaugaaccagcugacgcagacccaacuuuucacaagcuauaaugaucggcugcagaaaaaccuacccacuguaccuaucgaauacucccaggguuuucagaagaaaagaauagaccauaggcaccaugcuauggaugcccucgugauugcgugcgccacccgagagcacaucaauuacaugaacaaucaacacgcucuggacaagucaaaagauaagaaggagaaacagcagagccggaucgacuugcgcacaauucugugugaaaagaaaaacaacaauuggcaguucaagaaaccauggucuacuuuuacccaagaggcaaaggaagccuuagagcauauaguugucuccuucaagcagaaccucagagugaucaauaaagcuacgaacuauuacgaaaagugggaggagaaaaauggcgugcuggucaagaaaaagguuaagcaggaagggacaaacugggccauuaggaaaccccuucacaaggagaccgugaguggaaaaaucgugcuggaucggaagauuggcaaagacaagaucuugacugcaacacgaaaggcgguagauauaaccuuuacugagaaaaucauuagcucuaucaccgacacagguauucaaaagauccuccugaauuaucuaaaauacaagggguccccugaagucgccuucucaacggaaggccuggaggagcuuaacaaaaauauagcucaguauaacaauggaaagaaacaucagccaauuuacaaggugagaaucuuugaagagggcaguaaguucccccucggggaaaccggagccaaagcaacuaaguauguugaggcugccaaagguacaaaccuguucuuuggcguguaccaggggaagggaaaacgcaccuacgcaacaaucccguugaaugaggucauugaaaggcaaaagcagggccugccuagcgugccagagcguaacgaaaagggugagcccuuacucuucucgcuguccccuaaugaccuuguuuaugugcccauggaaggggagaucgccgagacuauagauuuuaacaaucugucuaaagaacagaaggagcggauuuacaaaaccguaucauucacgggcaaccagugcuuuuucguccaagaagcuguggcgacaccaaucgugaacaagauggaguauucaccuuugaauaaaauggaaagagacauucucggaaccaugaucaaggaggucuguauaaagcugaaaguugauaggcuaggcaacauuacuaaggccuga

SEQ ID NO: 3392 - RNA, 4416 nt, Artificial Sequence
  Cas9 variant
augggcuacaaggcccccagaaacgacaaaggggagaucgauuauggagugggucuggaccucggcaaugggagcgucggauggguugcuauggauaaggacuaccaccuuauuagggcacggggccaugaacugauaggugcccgcuuguucgauccugcgaacuccgcugagaaucgacgugaaucuagaaccacaaggcggcgcuuaucaagaaggcgguggcgccugcgaaugcuagacagucucuuugccagcgagcuggcaaaaaucgauccaaacuuccuugccagaaggaaguauuccugggugcacccgaaagacgaacagaaucaugagaacugguacgggucuauuaucuuuggaucgaaggagcaagauaagcaguucuauaaagacuaccccacuauuuaucaucugcggaagaaauugacggaagauaccgagcgucacgacauccgcgaaauauacguagcuauccaccacauugugaaguacagaggccauuuucucagggagggcgagaucaauucagaaaaccuguucgauccugagggguuugucgaacugauuaaagacgugaucaagcucaauaacagcuaugacgagaguacaccaauauucgaagcaucccccgccgauguuucugaggcuuuacugaaugagcacacuagccgguccggacgaauugaagacacccuugauaaguuggacuuuucagugagucgcgucgauaaacaugagcugaaggguaugagagacgccgcgaaagcagugaucggcgccauuguagggaacacagcugauuucagcaagaucuuuaaucuagacaaccucgauaaagacucuaaggauaaucugaaacuuaaguucgccgacuccaacuuugacgaaaaguacggaggcguuguggguucagggcuguuggaugagacccagaucgaacucgucgacaggauucacgcaguguaugaugcuguggcccugaaaggaauauuaggcgacgcgcacacuaucagcgaggccaaggucgagaguuacgaaaaacaucggaagaacuggaaacugauuaaggaggaacuccgcacaaaggagaauaaagaugaaguugaccuuugguauggcgaucugucugggagacaguacaagaacccuccagaccccgagaaaggaccugaugaggguuccaagaaagacagcccaaucagggauucggaccaaaagcagaauuugauaaagaaagcaaacgauuauuucaccgaacuaauugacgacucucagcuguccgaggaacagaagaauugccucaaaaacgauaucaauaacggccaacuguucccggugcagcguucaagugacaaugggguaauccccuaccagauucaccuuaacgagcugcggcgaaucauugagaaucagaagcaauacuauccuuuucuagcugaaacguucauaagaaaaacugccgagggaaagagcuacgaagagaacaagaucguggcucuccugaaauuuagggucccauauuacgugggccccuuaguuuccaaggaagauauggaggagcauucuagcgguaauucagccuaucacuggauggcacgcaacccugggcggggcgaagccauuaccccauggaauuucgacgagguggucgauaaagacgaaaguggagcuagauuuaucuccaggcugacaggcacugauaccuaccuacucggggagcccacacugccgcagcauagccuuuuguaugaagaguacauggugcugucugagcucaacaacguacgccugaauguucgacagggaaaccacuggucagacaagaaucggcaacgucuuaguuacaaacagaaggaguuccugaucgaaaacuuguuuaaagaacacaagaccgugacgagaaagagggcggaggauugucucagcuccauggguugcggcgaaguccagcuguucggguuaucugacgagaaaaaguuugcaucgagccuguccucauauauuacuuugaaaaagauacucggaaaagccuucguggaugacaguggcaauucugcuauccuggagcgcauuaucgaaguccagacaguguuugaggaucgggaaccucuuacccaucaauugagccugauugacucccucacuguugagcagagaaagcagcuggccaagauccacuacacagguugggggaaauuaucaaggaagcugcuuaccagcaaaaagggcucuuauaaaauacauucccagaacgagaucaugcgaacgcaacacaguauuaucgacauuaugcgcggagauagcuugaaucucaucgaaauaauucgggacaagaagaucggcauuggggaguggaucgauaacgaaaaucuggacagagagaccggagaaucugauguguccaggcuagagucaguauucgaggguauagucaugaguccccgugugaaacgcggcguugugcaggcaguccgggugaucgacgaucuggccaaggcuauugggaacccaccucagagaaucuuuauugaaauggccgacgagguacaggcaagccaaaggacagugucgcgacucucccggcugaaagcgcuuuacggaucucccagcuugcagaaggaguucaaugaucugaaagacuuacgcaagucacucaacgaaacuaaggaugcugaccugcaggaagacagacuuuaucuguacuauauccaguugggcaaagaucucuacaccgguaaggagauaaguauugacucccugucuagcgccuacgauaucgaccacaucguuccacaagcacuaacacaggaugacuccauugauaauaggguccuggugucacggaaagagaacgcccgaaagacugacagcuaucucuacacccccgaucugaucaaaaauaugagaccucuuugggggaaguugcuggcugccggcuuaaugagucagaaaaaguaugacgcacucacacgcguggaugacuucaaggauagggaaaaacaacguuuuguccagcggucucugguugagaccagacagauuaugaagaacguguccacuauacuuaggacguacuauggagaagacacaaacgugguaacccugaaaagcucgaucacucaugacaugcgcaaguaccuaggcuucccauauaaaaaucgagauauuaacgacuaccaccaugcucaggaugcccucuguaucucagcggccgggcaauuuaugcugaauagacacuucgucucuggaggcgaggugaccgacggugcuaguaacgcauacaauauguauuuggccgaauaccugcaggaguuucgggaugcuaaggccaggggagagcgcaagcguuccacagcauucggauuuguugugggcagcaugucuagcaaagacgaugaaaagagaaccgaccaucggacuggugagauugucugguccgaaacaaacgcggaguauuuaaggaaagugaugaauuacaagaaaaugcucaucacgcagaagguuggcgaugugaagacccgcgcccuguaugacgagacucgauacgggcacaaagaaucaagugcuaagagcauaaaauucgauaaccuuagacgggacacaucucuguauggaggcuuuuccggggccucaaccgcauacaugauguugguagaguacaagaaaaagaauaagcucgucaguaucacagcucaggaagccagccugcuagcaguggccgaucagaaaaacgacacuguguccgucauggacgggauucuggcuucucacggccuuucgggugcgaagauccuccugccgaaaauuguuaccgggcaauugcuggauuauagcgacgccuuagugacgcuccagucagcauccgagcugaauaccgcuaggcagauguggcuuccccgcaacgauuacaaugacaucgauauaauucugaagaguaaagacaucgaagaugccgcccauaaguugggauaugacucugauacaguacacgugcucagaaggauccaaaagcuguucgaggcugucuuucggguggcagagagccaguucccucuacaucagcuguccaaagaccaacaggaagagauucuucgugauccacagaacuacggcuuugguucagccguuaagcuccugggcggguuguuaaaagcgcugcacgcuaaugccgaaaacacuaaccucgcaggacuggugaagguccuucauggcgacaaagaguauucugacgaugggaaggccaaagaguucaagaaguucggauuuagcccccgcuggcgaagaauaaguaauccuaccggcuucacacuguccgacagcgauacuuuuaucuaccagucuccaucagguauuuucgaacaaagggugaccguuaaagaguugaaggaaaaagcugacaagcagaaauga

SEQ ID NO: 3393 - RNA, 4422 nt, Artificial Sequence
  Cas9 variant
augaagaacauccugggccucgaccuugggaccaauagcauuggaugggcccugauagagaaagauacagaccagaagaacgguaauaucuugggcacuggguccagaauuauccccaugucucaagauauuaaagacgaauuuggaaagggcaacucaaucagucagacggcugauaggaccaaauuucggagcgugcgccgauuacgugagagacaucugcuaaggcgggaacgccuccacagaguccugaauguucuugguuuccugccuaagcacuacgcagaccagauagauuuuaagaaaagguuggggaagcucgugaacgagacagaaccaaaacugguauaugacaauaagaacuucaucuuuaaaaaguccuucgaggccaugcugucugauuuuaaucagcaucaaccgcucuuacuggcggacggaaagaaagugcccuucgauuggacuauuuacuaucuucggaagaaagcucuuaccgagaagaucgaaaaagaggaacuggccuggcuaauucucaacuuuaaucagaagcgcggcuacuaucagcugcgaggcgaggaggaagaggaaaacccuaauaaaauggucgcauuccacucgcuuaagaucguggagguuauagccgacgaaucacagaaggggaaagcugagacaugguacagccugauuuuggagaacggauggaucuauagaaggaguuccaagaccccacucuacgauuggaaagguaagcaacgggacuuuauugugacuacagaccugaaugaugacggcucuaucaaaaccgauaaggaaggguuagagaagcguagcuuccgcgcacccgucgaagacgauuggacgcuggugaaaaagaaaacugagcaggaaaucaacagaucccauaagaccguaggaacauacauuuaugagaaccuccuucaggacccuaaacagaagauaaagggcaaacugguuaggacuaucgagcgggaauuuuacaaggaugaguugaaaaugauucuaaagaaucaacagaaauuccacccagaacugaacgacgagcaccucuauaucaauugcgugcgagaacuguaccgcaacaaucaggcccaucaaaccauacuuucaaagaaggauuucguccaccuguuuauugacgauaucaucuucuaucagagacccuugaggagucagaaaagcucuauuuccaacuguacacucgaguuucggaaguacaaaaaugagaacgguaccgaccagacggacuaucugaaggcuaucccuaaaucacauccauuauuccaagaauuucgccuguggcaguggauuuacaaucuagggauauaccagaaggaggaugacacuaacgugacagaugaacucaucaaaaauauugacggauaucaggaucuguucgacuuucuuaacaauaagaaggagaucagacaagauaucuugauuaaauuccugguggagcagaccggccucaagggcaaaccgcugagcagugucguugccaaguacagguggaacuuuguggaagacaaaauauaucccugcaaugagacugggacacagauccguacccggcuugcgaagguagaaaacacgccugaggauuuccugaccgcagaaacagagauuaaguuguggcacaucauuuacucugugaacgacaaagccgauuaugagaaggcucucaaaacuuuugccgaaaagcacaaucuggacacccauuccuucgucgagaacuuuaaaaaguucccacccuucaagagcgaauacggaucguuuucugagaaagcaaucaagaaauuacugccucuaauacgacucgguaaguauugguccugggaaaauaucgauaaaaagacacaggagagaauugagaagauccugacuggcgaguucgacgaagcuauuaaaucaagggugcgcgacaaggccauccaccuuaccgaagaggaucauuuucaaggguugcagcuguggcucgcgaguuacguuguguacggacggcacagcgaagccgacaaccuggauaaauggcauacagucgcagacuuagaggauuaucuggcugaguucagacagcacucccuuaggaauccaauaguggaacagguaauuaccgagacuuugcgcguugugaaggacaucuggcuccaauacggccagggugccaaagauuucuucucugaaauucacaucgagcuggcucgagagaugaagaacacgggggacgaacggaaacgucuaacaagccuggucaccgauaaugagaacacuaaucucagaauaaaggugcugcuuucagaauugcugaacgacggcaaugucgagaacgugaggcccuauaguccgaugcagcaagaagccuuaaagaucuuugaggauggaguucucaauuccgacauugagaucgaagaugacauucugaaaaucagcaagauggcacagccuaccaacacagagcuuaaacgcuacaagcugugguuggaacagaaauaucggucucccuacaccggccagauaauuccacucaauagacuguucacugccgacuaugagaucgaacauaucauuccucaaucaagguuuuucgaugacaguuuuagcaacaagaucauuugugaguccgcugugaaccagcuaaaggauaaacagcuggggcucgaguucauaaagaaucacucuggaacaaucguaaaacuggguaugggcaagacggcgaaaauucuugacgucgaaucguacaacgaguuugugaaggggaauuacaccaagaacaucagcaaacgaaauaaguugaugcuggaagagauucccgauaaaaugaucgaacgccaguuaaacgacacucgguauauauccaaguucaucauuucagcacucaguaauaucguuagaucugagagcaacgaugacggauucaauuccaaaaacgugcugccaggcaaugguaagauuacaucaaggcuuaagcaagauugggggaugaacgacaucuggaaugagcugauacuaccccguuuugaacgcaugaacaaaauuaccgauagcgccgucuucacagcuuggaaugagaacaaccagaaguuucucccuaucgugccacuggaguucucuaaaggcuuucagaagaaacggaucgaccauagacaccacgccuuggacgcacugguaauugccgcuuccacuagggaacauauaaauuuacucaacaaugagcacgccaagagugauaagcgauucgaccugaaccggaaacuucgcaaguuugaaaaaguggcauacaaugauccgaagaccggaaaaagaaucgagaaggaaguucccacgauuuuccugaaaccuugggagaccuuuacagucgacgcgaagaacagcuuggaaucuaucauuguguccuucaagcagaaucucagggugaucaaccgggcuacuaauuauucagagaguuacaacgaugagaauggcgcccugcgacuagggaaagacggaaacccacugaaggagaaaauaaagcaaagcaaaggugauucgugggcaaucagaaagcccaugcauaaggacuuugucuauggcaaaguucaccuucagaaugugaagcucccuaaagauaaguucauuaccgccauccgcaaaucccuggacgugacauucgauuugaagaggauugaaacuaucaccgacacggggauacagaagauucugaaaaacuacuuacauucuaaggaaaauaaaguagagcucgcuuuuagcccagaaggaaucgaggauaugaaccaacacaucgagcguuauaaugacggcaagaaacaccagcccauucauaagguccggguguucgaaaucgguucaagauuuagucugggggaguccggcaacaagaaaacaaaguucguugaagccgcaaaaggaaccaacuuguuuuucgcuguguaccaggacgauaauaagggcaaaaggaacuacgagacuauaccgcugaauauugucaucgaacgccagaaguuggggcuccacucugugccuacagaggacgccaaaggaggcaagcugcuauuucaucugagcccaaacgauaugguuuaugugcccaccuccgaggaacuugaggacaaucucgcgucaguaaacauuaagcgacugaauacugcccaaagaaaacggaucuacaaggucgaaaaagcuagcgguguggagugcuauuucauaaggcaggauauugcauacuugaucaagaacuaugacgccaaaaccaagaucggggaguuagaaagucagaauaagcugcagacaacgaugaccgaugaccgccucaaaauuacugaugugugugucaagcugaacaucgaccgucuuggaucuauugcugagacauuucugggcaaucaauacggugccuccaaaaagaccuga

SEQ ID NO: 3394 - RNA, 4422 nt, Artificial Sequence
  Cas9 variant
auggccaagauccugggccucgaccuugggaccaacagcauuggaugggcuguggucgagagagaaaauauagauuucucccugaucgacaaagguguuaggaucuuuucugagggcgugaagucagaaaaagggauugagaguagccgggcagccgaacgcacaggauaccgauccgcgcguaagauuaaauauagaaggaaguugcggaaguacgagacuuuaaaaguacugucucuaaaccgcaugugcccccucucgaucgaggaaguggaggaauggaagaaaucaggcuucaaggauuauccucugaauccagaguuucuuaaauggcugagcacggacgaggaaaguaacgucaauccguacuucuuuagagauagggcuuccaagcacaaggugucuuuguucgagcucggucgggccuuuuaucauauagcacagcgccgaggguuccugagcaacagacuggaccaauccgccgaaggaauccucgaggaacacugucccaaaauugaggcuaucguugaggauuuaauuucaaucgacgaaauaaguaccaauauuacagauuacuuuuucgagacuggcauccuggacagcaacgaaaagaauggcuaugcaaaagaucuugacgagggggauaagaaauuggugucucuguacaagucccuacucgccauucugaaaaagaacgaaucagacuuugagaauugcaagagcgagaucaucgaaaggcuuaacaaaaaggacguccugggaaaagugaaggguaaaauuaaggauauaagucaggcuauguuggacggcaauuacaagacccucgggcaguauuucuacucucuguauuccaaagagaagauccggaaccaguacacaagccgugaggaacauuauuuaucggaauuuauuaccaucuguaaaguacaaggaauagaucagauuaaugaggaggaaaagaucaacgagaaaaaguucgacggccuggccaaggaucucuacaaagcgaucuucuuucagcgcccucuuaagucucagaaaggucugauugggaagugcuccuucgaaaaaucaaagaguagaugugcaaucagccacccagacuuugaggaguauaggauguggacuuacuugaacacaauuaagauaggaacccaauccgauaaaaagcuacgguuccugacgcaggacgaaaaacucaagcugguucccaaauuuuaccgaaagaaugauuucaacuuugacgugcuugccaaagagcugaucgaaaagggcucuagcuucggcuuuuauaagucaaguaaaaagaaugauuucuuuuacugguucaacuauaaaccuacugacaccgucgcugccugccagguggcagcuuccuugaagaaugccauuggggaggacuggaaaacaaagagcuuuaaguaccagacuaucaacucuaauaaagaacaagugucacgcaccgucgauuauaaggaccucuggcaucuguuaacaguugcgaccagugauguguaccuguaugaguucgccaucgacaaacuaggacucgaugagaagaacgcaaaggcuuucagcaagacgaagcugaaaaaggacuuugccucccuuucuuugucggcuauuaauaaaauacugccauaccucaaggaaggucugcuuuacagccacgccguauucguggcaaacaucgagaauauugucgaugaaaacaucuggaaagacgagaagcagagagauuauauuaagacucagaucuccgaaauaaucgagaauuacacacuggagaaaucaagguuugaaauuaucaacggcuugcucaaggaguauaaaagugaaaaugaggacgggaagcggguguacuauucuaaagaagccgagcagagcuucgagaacgaucugaagaaaaaguuaguucuguuuuacaaguccaacgaaauugagaauaaagaacagcaggagaccaucuucaacgagcuacuccccauauuuauucagcaacugaaggacuaugaguucaucaaaauucagcgccuugaucagaagguguugaucuuucugaaaggaaagaaugaaacuggccagauauucuguacagaagagaaggguaccgcugaagagaaagagaagaaaaucaagaacagacucaaaaagcuguaccacccuucagacauugaaaaguuuaaaaagaaaaucauuaaggacgaguucgggaaugaaaagaucgucuuaggcagcccacugacgccgucuauaaagaaccccauggcgaugagggcacuucaucaauugcguaaggugcucaaugcccugauucuagagggacagaucgaugagaaaaccaucauucacaucgaaauggcucgggagcugaacgacgccaauaagcgaaaaggcauucaggauuaccagaacgacaauaagaaauuuagagaagaugcaauaaaggagaucaagaaacucuauuucgaagacugcaagaaagagguagaaccuacagaggaugacauucugagguaccaacuuuggauggagcagaaccgcuccgaaaucuaugaggaagggaagaauauuaguaucugugauauaaucggaagcaacccagccuacgacauugagcauacuaucccccggucuagaucccaggauaauucacagaugaacaaaaccuugugcagucaaagguucaaccgcgagguuaagaaacagagcaugccuauugaacugaauaaccacuuagagauccucccacgaauagcucacuggaaggaagaggccgacaaucugacacgggaaauugagaucaucucgcguuccauuaaggcagcggcuacuaaagagauaaaggauaaaaagaucagaaggcgccauuaucuuacccugaaacgggacuacuugcaggguaaguaugacagauuuauuugggaggaacccaaggugggcuucaaaaacucucaaaucccggauacagggauuaucaccaaguacgcccaggcauaccucaaaagcuauuuuaagaaagucgaaucagugaagggaggcauggucgccgaguucaggaagauaugggguauccaggaaaguuuuauugacgagaaugggaugaaacacuacaaggugaaagaucgauccaagcauacucaccauacgaucgacgcuauuacaaucgccuguaugaccaaagagaaguaugauguucuggcacacgcuuggacucuagaagaccagcaaaacaagaaagaggcccgcucuauaauugaagcgagcaagccuuggaaaaccuucaaggaggaucugcucaaaaucgaagaggagauccuggugucccacuacacacccgacaauguaaagaaacaggccaagaagauuguccgggugagaggcaaaaagcaguuuguugcugaaguggagagggaugucaacggaaaagcagugccaaagaaagccgcuucaggcaagaccaucuauaaacuugacggggaagguaaaaaguugccucgucugcagcaaggagauacuauacgcggcagcuuacaucaggacaguauuuacggggccaucaaaaauccccucaacacagacgagauuaaguauguaauccggaaagaucuggagucuauaaagggauccgacguggaaagcauuguugaugaggucgugaaggagaaaaucaaggaagcaaucgcgaauaaagugcuucugcuaucgucaaacgcccagcagaagaauaaacucgucggcacgguuuggaugaacgaagagaagagaauugcuaucaauaaggugaggauuuacgccaacucugugaaaaacccacugcacauaaaggagcauaguuugcuguccaaaagcaagcacguacacaaacaaaaggucuacggucagaaugacgaaaacuaugcaauggcuaucuacgaguuagaugggaaacgagacuucgaacucauuaauaucuuuaaccuggccaaacuuaucaagcagggccaaggauucuauccccugcauaaaaagaaagagauuaagggcaaaauaguguuuguuccuaucgaaaagcggaauaagcgcgauguggucuugaaaagagggcaacaggugguuuucuacgacaaggagguggagaacccaaaagauauuucugaaaucguagacuucaagggaaggauuuauaucauagagggccucagcauccagcggauuguccgaccguccgguaaaguggaugaauacggggugaucaugcugagauauuuuaaggaggcacgcaaggccgacgauauuaaacaagacaauuucaagcccgacggagucuuuaaacuaggcgaaaacaagccuaccaggaaaaugaaucacaaccaguucacugcuuuuguugaggguaucgauuucaaggugcugccaucaggcaaguuugagaaaauauga

SEQ ID NO: 3395 - RNA, 4425 nt, Artificial Sequence
  Cas9 variant
augaagaaaauccugggccucgaccuugggaccaacagcauuggaugggcccugauagaguccgauuucgaaaagaaacaggguaagaucaauggcuuggggucuagaauuauccccaugucacaagacauuuuaggaaaauuugauaguggcgugagcaucucccagacagcugagaggacuucuuaccgggguguccgccgacugaaccagcguaaucuacucagaagggaacggcugcaccgcguucuuaacauacuggacuucuugccuaagcauuauucgaaugcaaucgauuuugagaagaaacucgggcaguucaaggaaaacguggaggagaaacugaauuacgccaagaaccaaauuggaagacacgaauuuaucuucauggacucauuuaaagagaugguaaaggaguucaagcagacgcagccacagcuguuuuauaaaagggaaaauggcauugagaccaagaucccguacgauuggacacucuauuacuuacggaaaaaggcgcugagccaaaagauaaagaaagaggaacuugcuuggauuaucuugaacuucaaucagaagcgcggcuauuaccagcugcgaggggaagacgugcuagaugagaguaagauugaagacuuuuacucccucaaagucguggagguucaggagacugaagauaagaacgccagaggaaccugguauaaugugauccuggagaacgacugggucuacaaaaggcaaucuaaggaaagccuugauaauuggaucgguaaaaacaaggaguucauugugacaaccaacaaggaaaaagacggcucccugaaguuggacaaagcagggaauguaaagcggaacuuucgugccguugauucagagaaagacuggauagcuaucaagaagaaaacugagcaggauguggaaauuaguaagcauacagucggacaguauaucuacgagacccuccugcaaaaugcaaaacagaagauaaaaggcaaguuagugaagacgauugaacgcaaauucuauaaggaggaguucaucaaaaucauuaaggaacagcugaaacaccaucccgagcuccagagcaagacucuuuacgaaaccugcauccaagagcuguauccuagaaacgaagcccaccagaauaacauuaaaucuaaggguuuugaguacuuguucacagacgauauaaucuuuuaccagaggccacuaaaguccaaaaagucaacuauuagcgggugucaguaugagacccggcuguucaaaaagacagugcucaauaaagucaccaacaaggaaaaugagaucuggcaaaaggaaccccugaaagcuaucaguaagucucacccucuuuuucaggaguuccgacuguggcaguuuuugaaaaaccucaagauuuaccagaaagaagacguuaagggaaaucugauagaucaugacaucacguccgauuuacugaagacugaggccgacuggguggagcuauucgauuuucucaacauuaaaaaggaaaucgagcaaaaacagauuauccaguucuuuauaaauaacaagcagaucgaaaaaggcaagaagaauaacuaucgcuggaacuacguagaggacaaaaaguauccaugcaaugaaacaaaaagccaacugauuucgagacuuaagaaagugaagaacuuggaccugaaucucuucuuuaccucugagacugagcugaaacuuuggcacaucauuuacuccgucaaggauaagauccaguaugaaaaagcgauaaagaacuucgcaauuaaaaauaacaucgacauugauucauucguggagaauuuuaagagguuucccccuuuuaaaaacgaauacgccgcuuacagugagaaggccaucaagcggcuguugccacucaugcgcaugggcgaauauuggaaugagagcgagauaaaacaggaaguuaaggacagagcauacuccaucauugagaggcugaaagggaucgauuucaacaaggacaaaauugaugaaaagaucacagacgaugacauaaagaaacaauuacugaagucuuuuauugauuucaaagacaagaauccgcuaaaaggacucaacaccuaucaggcuuguuaccugguguauaaucgucauagcgaggucaacucaaucgccuacuggaagagucccgaugacaucaauaaguaucuugaggguuuuaaacagcacuccuugcggaacccuauuguggaacagguaguuacggagacccugcgaacagugagagacaucuggcaauacuacggcaaggggaaagcgagcuucuuuaacgaaauucacgucgagcucggaagggaaaugaagaauccagccuauaaacgcaaggcaucuacuaaccgggugaccgagaaugagaacacaaaucauagaauaaaggaaauccugaaagaguuacagaacgaaggcguccaggaggugaagucauacaguaggaaucagcaagaaauucugaaaaucuaugaggaggguauuuaccagagcaucgauguuguggacgaugcuauagaaaagauccgcaaaaacuccucucccacuaaggccgagauuaucaaauauaaacuuugguuggaacagggguacaccucgccuuauacaggcaagaccauuccaaugagcaaacucuucacuacggacuaccagaucgagcacauaauuccccaaucccuguacuuugauaauucacuaaguaacaagaucaucugcgaaucugagguaaaucagcugaaagacaaccagacagcuuaugaguucauuaagaaacauggaaccgaaaaggucagccucggcaagaauaaaacuguggagauauuuacccuggaacaauacgagaagcacuguaaccaguauuucaaaaagaauaaaaacaaacuuaagaaauugcuguccgaggaaaucccggagggguucauuaaccgacaguuaaaugauucacgguacaucagcaaguuuauuaaaggacuccuggguaaccuuguucgugaagaggacgaacaggaggugacaaccaagcauaucgucccugugacuggcgccauaacaucuaaacugaagcaagauuggggguugaaugacaaguggaacgagcucguagcauccagauuccagaggcugaauacgaugaccaacaguaauaacuuuggauauugggauacuaaaaucaaugccuuccgcgugcagguucccgacgaaauuagcaagggcuuuucuaaaaagcggaucgaucacagacaccaugcucuagacgcgcuggucauugcaugcuguacaaggaaccacaucaauuaccucaacgcccugaaugcugagaaaaagaacuauggucuucgagacuugcuguuaauaaagaaugauaagaaccauuacaccaaguucuuuaaacacccaugggacggguucccuguggaagccaaguccgugcucgagaaaacaauuaucucauuuaagcagaauacucgcgucaucaacaaaaccaacaauaagacguggcaaugggcagaaaaggagggccagcugaaaaagguucuugugaaacagaccaagggagauaacugggccauucggaaacccaugcacaaggagacagugaguggcaagcugaauaucccaacucccaaagggaagauagcuaccgccagcagaguaucgcuauccgaaauuaaaacaaggaagcagcucgacaaaaucacugauauuucuauccaaaagauacuggagcgucauuugaacaauuaccuggacgauaagggaaaagaaaaguucgacuuagcauuuaacgcggauggugucgaggaacucaauaaaaacauuaaggugcugaauaaaggcaagaaccaccagccuaucuauaaaguucgccuuuacgagaucgggagccgguucaaggugggaaauucaggcaacaagaaagacaaguaugucgaggcugccaaagguaccaaucuguucuuugcaauuuacuugaacgaaaaggauaaaaagagaguguaugagacgaucccacucaaugaaguuauugagcaucagaaacaggugaguaaccugccgaagaacgagaggacacccguaccugucaaucacaccaaggggaaauuccuauuuucccugucuccaaacgaccuuguguacgugcccacugacgaagagauagauaauccuagccucgucaacuucaauaaccugaauaagaaacaaguugaaaagaucuauaagacaguguccugcucaaccuaccaguguuucuucguacauaacacuauuagcaaaccaauccagaauaagguggaguuuagugccuugaacaaaauggaaaagucuaucgacggcauuaugauaaaagaucgaugcuggaagcugaagauggaccgguuaggaaauaucauuuccgucauccgcuga

SEQ ID NO: 3396 - RNA, 4443 nt, Artificial Sequence
  Cas9 variant
augaagaccauccugggccucgaccuugggacaaacagcauuggaugggccaaagugugcgucgauaaugacgguaacuaccugagagauauaaaguugggcuccaggaucauucccaugucucaggacacuuuagggaauuucgauaaaggaguuacggacucaccuaccgcugcacggacaggcuuucgcggugugcgacguaucagagagagggcccugcaacggcgcgaaagacuacacaggguacuccaugugaugaaguuccugccaccgcacuaugagaacgcgauuggguggaaucgggaagaggcuacuaccuacggaaaauuucuuaaccauggcgaacccaagcuggccugggagaagcaggaggauggcaguaugcgcuucuuguuuauggacagcuuccacgaaaugauggcagauuuugccgagucccagccugggcucgucgcuggagguaaaaagaucccacuggacuggacacuguauuaccuccgaaagaaagcauuaacccaggccauaagaaaagaggaacuggcuuggauccuuuugaauuucaaccaaaagaggggcuauuaccagcugagaggggaggaagaugaggaaaaucccgccaagcgugaggaauaucaugagcuaaaagugguuucuguggaggcggcagaagagggaaagggcgguaacacuugguacaaugucacacucgaaaacggguggauuuaccgcagacagucgaaaguggagcugcacgacuggguaggaaagaccaggcaguuuaucguuacgacugaauaugagaaagauggcgugaccauuaagaaagacaagaauggcgaggucaagcggucauuccgagccccuagcgaagacgauugggggcuucgcaaaaagagaacagagagucuguuggaagacuccggaaaaacugugggugcuuuuaucuacgaucacauacucucugagccaaccgacaagauuaggggcaacuucauccggacaauugaacgcaaauauuacaagaaggagcuggaggccaucuuacuggaacaaaccaaacaucacaaggagcucaaagaucagaauacgcuuaucgcauguauuaaggaacuguaucagagcaacaaaccccaucaggacuccuugaugaagaaggauaugacuuaccuacugauaacagaccucaucuuuuaucaaagaccucugaaaucaaagaaaagucuuauugcugauugcccauacgaguacuaugaguacaccaucaaggaaacuggggagauaaaaaggcagggaauuaaguguaucgccaagagcaacccguauuaccaggaauuucgucuguggcaauucaucauuaauuugcggcucuuugaccgaacagaugacaaagaggugaccucugaauaucuguccucaauggaggacuacacgaaguuauucaccuaucugaacgauagaaaagacaucaaucaggagacacuacucaaggauuucuucaaacagaagaaagucaagaugggcauggaaaaggaguuucccauuagguggaacuacauagaagacaaagagaagaaauacccuugcaaugaaacucgccacgagcugcuugcggccuuggauaaggcagguaucgaccacagcuggcuggaugacaaagagcgguucuauagacucuggcaucugcuuuacaguguugaaucuaaggaggaagcugagggggcccugaggaaguugaaagauaacgacgauuuugugaaugcuuuccucaagguaaaaccauuuaagaaagacuauggcgccuacuccgaaaaggcagugaagaaacuguuagccauuaugcgcaugggaggccuguggaacgagaccgauaucugugagcagacacgaaaucggauccaaagcauuauaaagggggaaaucgacgagaaaauuaaggaacguaugggaagaacuuucugccagcuaucggacuuucagggucuccccgaguggcuggcuuguuaugucguguacggcaggcacucugaggcgaccgauauccagcgcuggacaaaaccugaaaaccuuauggcauauauuaauggguucaagcaacauuccuugcggaacccaaucguugagcagugcauacuggaaacccucagaacugugcacgacaucuggaaggaggccggacauauugaugaaauccacgucgagcugggcaggucaaugaaaaguacggcugaccagcgagcccgcaugagcaaguccauuuuacagaaugagaacacaaaucugcggaucaaaucucuuuugauggaacucaagaacgcaaaagagauagaaaacgugagacccuacagcccgaugcaacaggagauucugaggaucuacgaagagggugcccuacaggagcugaccaaggaagaugcucaguauccugagauuucaaaaaucagucaaauggcccagcccuccgcaaaggaacuccugaaguaccgucuuugguuggagcagaaauauuguagcccauacacugggaagccuauaucucugucaaaauuauuuaccagugcguaucaaaucgaacacauuaucccccagagccgcuacuucgacgauuccuucacaaauaagguaauuugcgagaccgagguuaaccagcucaaaucuaauaugcugggcuaugaauuuaucaagaagcauucgggagagauagugcacuguacuacaauuggcgacgucaaaauccuugaugcuaaggaauacuacaacuucgugacggagcauuaugccaauaaccggcggaaaaaggagaaacuguugcucgaagacaucccacaggaguuucugaauaggcaaaugaacgauagccgauacauuuccaagaaggucauggcaauccuaucaaauauugugcgggaagaggacgaacaggagaccaacaguaaauucguugugucuugcagcgggggaauaacugaucgccugaagcaggacuggggucucaaugacguauggaacuccaucgucuaucccagauuugagaggcugaauaaacuuacacagaccgaagccuucggccggugggagaacaaggaagggaaacaaguguuucagacaucauugccucuggaguuacagcgaggauucagcaagaagagaauugaucaccgccaccaugcuauggacgcccucguuaucgcaugcgcuucuaggaauauuaucaacuaccugaacaaugaauccgccaaaagucaggagcaacgugaggaucuucggaagaaacugugugacaagaacagaauaaucaggaaaccaugggaaacuuuuacccaggaugcgcgcacggcccuagaggacguggucgugagcuucaagaauuauguacgagugauuaacaaggcuaccaauuacuaugaaaaauacgaugagucuggcaagaaagguauggcagaacagaaggggcaagacaugugggccaucagaaaaccgaugcacaaggagacaguuuuuggccaggucaaccuccggaggaaagugacugugaagcugaaggaugcuuuggagaauauucccgccaucugcgacaaagcacugcgcgauuacgucaacgacuuaauagcgaagaaauucaauaccaagcagaugcucgcccauuuuaaauccauuaacuaucgucugaauaugaagucaguuaacaaggugggaaucuggguguucagugacgaaaaagagccuaugguagcuacaagaaaggccaucgauauuagcuucgacgcaaaacggauagauacuaucaccgacacgggcauucagcaaauccuuuguaaguaccugaaaucgaaggggaaugauccaaacgucgcuuuuacacccgaaggaauugccgagaugaauaagcacaucauagacuauaacaacggcaaacagcaucagccuaucuugaaggugaggguuuccgagccaaaaggugcaaaguaccaggugggggaaaccggaaauaaaacuaagaaguucgucgaggcccaaaaaggcacaaaccucuauuuugcuauuuacgaagauaaggacgguaaucgcucuuauaacaccaucccccugaaugagguggcggaacgacuaaaacagggccugagcccgguuccugagaagaacgagaaagggauuucacuuaaguucuaccucaguccaaaugaucugguguacguacccacugaagaggaaaaauuguccaacgagugcaagcugucuaaggaaagaaucuauaaaauggucagcuccaccucaaaugagugucacuuuauaccuuacacaacggccaagcccauuuaugacaaauucgaguacgaagcaaagaacaaaaugggacgggcuuuaaccggcgagaugaucaaggccgugugcuggaagcucgaaguggauaggcuggggaauauccuuaaaauuaucaaguga

SEQ ID NO: 3397 - RNA, 4452 nt, Artificial Sequence
  Cas9 variant
augaagaccauccugggccucgaccuugggacaaacagcauuggaugggccaaaauauccaucgaugacaaugguaacuaccugagagauauucagaugggcucuaggaucauucccaugucacaagacguguuggggaauuucgauaguggagucacugagagccagacggcuguucggaccggcuuucgcgguuuacgacguaucagagaaaggucccugcuacggcgcgagagacuccacagggugcugcauguaaugggguuccuuccuccacacuaugacucugcaauaggauggaacaaggaggaaccgacaacuuacggcaaauuucugaaucauggcgaacccaaguuggccugggagcggcagggggauggaucgaugcgcuuccucuuuauggacucauuccacaaaaugauggaggauuuugcgccucaucagccagcucugguggccgacggucgaaagaucccccuggauuggacccucuauuacuuaagaaagaaagcacugacacaaccuauuaagaaagaggaacuugccuggaucuugcugaacuucaaucagaagaggggcuauuaccagcuacguggggaagaggaggaagagaacccaaccaaacgggaagaguaucacgaacucaaggucgugagcguugaggcugcagaggaaggaaagggcgguaauacuugguacaacgugaaacuggagaauggguggauuuaccgcagaaguuccaagaucccccuugacgauugggucggaaaaacaaggccuuuuauagugaccacggaauaugaggccgacggcauuacucugaagaaaaacaaggaaggcgagguaaaacggucuuuccgagcuccaggggaggacgauuggggauugcgcaagaagagaaccgaaagccagcucgaggccuccgguaaaacaguuggcgcguuuaucuacgaccaccuguuagcagaaccggccgauaagauuagggggaauuucauccggacuaucgagcgcaaauauuacaagcaagaacuggcugacauucucagagagcagucaaaauaucaugaggaacuucagaguaagaagauacuggccgauugcgcagaggaauuguacaggagcaaccagccccaccgugacucucuacugaaaaaggauaugguguaucuccugcuuaccgacaucauuuucuaccaacggccucugaaauccaagaaaucauugaucgcugauuguccauacgaguauuacgaguaugucgacaaggaaacaggagagauaaagcgacagggcauuaaaugcguggccaagagcaaucccuacuaucaggaauuuagacucuggcaauucgugcugaacuuaaggcuguacgaucgcaccgaggacaaagaagucacggcggaguaucuaccuaguaaggaggacuacgcccggcucuuuguuuaccugaacgauagaaaagaaaucaaucaggagacucuuuugaaggacuucuuuaagcugaaaaaggugaaacagaggucugaaaaggaguucccaguacgcuggaacuauaucgaagauaaagagaagaaauaccccuguaaugagacacgacaugaacuccugauggcacuugaccgggcugguauugagcguuccuggcuggaugacaccgccagacagugcagguuguggcaccuccuguauagcaucgaagugaaggaugaggcugaacgcgccuuacggaagcugaaagacgaugacgaguuugucucggcauuccuaaaggugaaaccguuuaagaaagauuacggggccuauucugagaaggcuguuaagaaacuccuggcggugaugagaaugggcucccacuggugugaagacgauauuugcaaggagacuaaagaaaggauagagcauauccuucaaggagacgucgaggaaaagauuaaagagcgaaugaaccacacagcauacucauugggcgaacugagugacuuccaggcccucccugaguggcuggcuuguuaugugguauacgggcgccauagcgaagccaccgauaucaagcacuggaagacgcccgaguccuuaauggcauacaucaauggauuuaaacagcauucucugcggaacccaauuguugagcagugcauacuugaaaccuugagaacagugcacgacaucuggaaggaggccggucacauugaugaaauccaugucgagcucggcaggagcaugaaaucaaccagugaccaacgugcucgcaugacugaaaauauucugcggaacgagaauacaaaccuaagaaucaagucccugcucauggagcugaaaaaugaugccgacauaaaggaugugaggccuuauagccccaugcagcaggaaauccuucgaauuuacgaggaaggggcauugcaggagcugacuaaggaagacaacgauuaugaggagaucuucaaaauuucuaagaugccacaacccucagcgaaagaauuacucaaguacaaacuguggcuugagcagaaguaucggaguccuuacaccggaaaaccaaucagccuguccaaguuguuuacaucugcuuaucagauagaacacauuaucccgcagucgcgcuacuucgacgauagcuuuaauaacaaggucauuugugaguccgaggugaaugcccucaaaggcaacaugcuggguuacgaguucaucaagaaccaugggggcgaaauaguucacugcacccuacugggagacgugaaaguacaaaaugaaucagaguauaaggcauucgucacugaacacuacgccaacaauaaauauaagaaggagaaacuccugauggaggauaucccccaggacuuucuuaacagacauuugaaugacaguagguacauuucuaaggugguuaaaacgcuguuaagcaacaucgugcggacagaagaugagauggaaaccacuuccaaguucgucgugucauguaccggcgggauuacagaccgacucaaaaaggauuggggacugaaugacguauggaacagcaucguguauucuagauuugagcgccuuaaugaacugaccaaguccgaugcuuucgguaggugggagaacaaagagggcaagcguguuuuucagacaagugucccucuagaacuccaacggggguucaauaaaaagagaauagaccacaggcaucacgccauggaugcacuggugauugcuugcgccagccgcaacaucaucaauuacuugaacaaugagucugcgaacuccccaaagaagcgagaagaccugagacagcaguuaugcgauaagaaccggauuaucaggaaacccugggagucauuuacucaggacgcccgcgcugcacucgaagauguggucguuaguuucaagaauuaugugcgugugauuaacaaagccacgaauuacuacgagagauaugacgcugacggaaagaaaaccauaacuaagcaaaagagccgggagaugugggccguaaggaaaccuaugcauaaggaaacagucuuuggccacgugaaccugcgccgaaaagcaaucguuaaacuuaaagaugcgcuggagaauauuccaucgaucuguaacaaggaauugagagacuacauuaauggucucguggagcggaacuucaauaccaaacagcugcacgcccauuuuagguccacagauuaucgcuggaacaagcagaaugucgacaagguggagguuuggagauucucugaugaaaaagagccccuaguggcuacuaggaagccgcuggacaccagcuuugaugccaaacggaucgacacgauaaccgauacagggauccagaagauucuucucaacuaccuggaagcaaaaggcggagacccuuugaucgcuuucacuccagagggcauugccgaaaugaaucaaaacaucgcacuguauaaugaugggaagaugcaccagcccauauuaaagguacguauuucagagccuaaaggagccaaguaccagaucggccagaccgguaacaaagcugacaaguucgucgaggcgcaaaaagggacaaaccucuauuuugccaucuacgaagaugaggaccgcaaucgaacuuacaacaccauuccccugaaugaaguggcagagagacuuaagcagggacugccaccugugcccgaaaagaacgagaaagaggucccauugaaguucuaucucaguccgaaugaccugguuuacgugccuacggaagaggaaauacuaaugaaagagugcaagcugaacaaaaauaggaucuauaagaugguauccucuacaggcaaccagugcuuuuucauucccuuucggguggcugucagcaucgugaauaagauggaauacuccccacuuaacaaaauggagaaggccauuucaagcgagaugaucaaagccguuuguuggaagcucgaaguggaucgccuggguaauauaaucagagucgugaaauga

SEQ ID NO: 3398 - RNA, 4452 nt, Artificial Sequence
  Cas9 variant
augaagaccauccugggccucgaccuugggacaaacagcauuggaugggccaaagugucccuggaugacaaugguaacuacuugcacgauauaaaguuaggcugcagaaucauucccaugucucaggacguccuggauaauuucgggaaaggaguuacugugucacaaacgaguguaaggaccggcuuucggggugugcgccgaauccgugagagaagccuacagaggcgggaacgccuccauagaguccugcacaggcuuggguuccugccucagcauuaugacgcugcaauuggaugggauuccgacugugccaagacauacggcaaauuuuuggauaacggcgagccaaagcucgcgugggaacggcaggaggacgggucuaugcgcuuccuguuuaugaacucguucuaugaaaugaucgcugauuuuacuucacaccaaccggcccugguggcagacggaaagaaaauaccccucgauuggaccuuauacuaucugcgaaagaaagcccuuacacaggcuaucagaaaggaggaguuggcauggauucugcuuagcuucaaucagaaaagggguuacuaucagcuccggggcgaagaggaagacgagaauccuaccaagcgugaggaauuuugcgagcugaagguuguggccgucgaagcugccgagaaagggaagggagacgauaucugguacaacgugcaucuugaaaauggcuguauuuaccgcagaaguuccaaaaucucucuggacgauuggguagguaagacuaaacaauucauaauuacaaccgaguaugagaaggacgggguuacgcccaaaaaggauaaggacggaaaagaaaagaggagcuaccgggcgccaaaagaggaugacuggggcuugcgaaagaaacgcacugaaaccgaucucgaggcauccggcaagacagugggggccuuuaucuaugaacaccuguuagcugagccuuucgacaagauuagaggaaacuuuauccacacuaucgagaggaaauacuaucgggccgaacuggaggcaauucucaccgaacagcgcaaguaccaugaggaacuuagaucagagcagaugcuggcugucugcgccgaggaauuguauaggaguaaucuaccacaccagcaaagccugcucaaaaaggauaugguguaccugcuucugucugacuugauauucuaccagcguccccucaaauccaagaagucacugaucgcggacuguccuuaugaguacuaucgguacguggauaaagaaacaggugagauuaagaaacagggcaucaagugcauagccaaaagcaacccauauuaccaagaguuccgauuauggcaguuuguccugaaucuaagacucuucgacaggaugaccgauaaggaaguuacggcagacuaucugccgacuaaggaggauuacgugcgccuuuuugacuacuugaacaaucggaaagaaauuaaccaggagacacugcucaaggauuucuuuagacugaaaaagguaaaacuugggagggaaaaggaguucgagauccgcuggaacuauaucgaagacaaagagaagaaguaccccuguaaugaaacccgauaugagcuguugguggcucucgaucgggccggaauugaccguaguuggaucgaugaagacggcagacaguacaggcuguggcauuuacuguauucuauugaggucaaagcugaggccgaauccgcacuacgcaagcucaacagcgaugacgccuuugugucgucuuuccugaaaguuaagccuuuuaaaaaggacuacggugcuuauuccgagaaggcggugaaaaagcuauuggcagucaugcggauggggucaauguggagugaagccaauauaugcgaggaaacucaaaacagaaucaggagcauuauccgaggcgauaucgaggagaaaauuaaggaacgcaugggacacacagcucgguccuucaaucagauagacgauuuucaggcccugccagaguggcucgcauguuacgugguauacggcagacacucugaaguuaccgacauccagcauugggagacgcccgagcaacugcagagcuauauuaacggguucaaacagcacucauuaaggaauccuaucguggaacagugcauucuggagacccuucguacaguccaugauaucuggaaggaagccggacacauagacgagauccauguggaauugggucgcgauaugaagcggacugcugaccaaagagccaggaugaccaaaaacauucucaagaaugagaacacaaaucugcgaaucaaaagucuacugauggagcucaagaaagauacugacauuaaggaaguccggccauacucccccaugcagcaggagauccugcgcauauaugaagagggcgcacuuuugcagcugaagagagaugacgaagcguuugcugauauuagcaaaaucucucaaauggcccagccgaccgcaacagaguuaaggcgguacaagcucuggcuggaccagaaauaucgaucaccuuacaccgggaaguucauuagucuuagcaaacuguucacuuccgccuaucaaaucgagcacgugauaccccagucuagauacuuugacgauucguucagcaacaagguuaucugugaagcugaggugaaucgcuugaaauccaacaugcucggauacgaauuuauuaaggcccacggcggugagaucguacauugcacgaugcugggggacgucaagauucuaucagaaagugaguauaaagcauucgugaaugagcacuacguuaaccauagggcuaagaaagaaaagcugcucauggaggauaucccacaggaauuucugaaccgucagaugaaugacucucgguauauaagcaaaguggucaaggcccuuuuguccaacauugugagaacagaggaugagauggacguaaccucaaaguucgugguuccuugcagcggcggaaucacugauaggcugaaaaaggacuggggcuuaaaugaugucuggaacucuaucguguacccccgcuuugaacgacucaauagaaugaccgggacagaggcguucggacacugggaaaacaaagaggguaagcggguguuucaaaccuccgucccaauugaacugcagcuuggcuucaguaaaaagaggaucgaccaccgccaucacgccauggaugcucugguuauugcaugugccagccguaauauaaucaacuaucuaaauaacgagucugcuaauucccagaagaaaagagaggaccuccggaggcuguugugcgacaagaaccgcauuauccgaaaacccugggaaucauuuacucaggaugccagaguggcacugcaagacauugugguaaguuucaagaauuacguccggaucauaaacaaagcgacaaauuauuacgagagguacgaugaacaggggaagaagacgaccgccgagcagaaaagcucggaaaugugggcuauccgcaagccuaugcauaaagagacuguguuuggacacguuaacuuaaagagaaaaacaaccgugaagcucaagaacgccauugagaauaucccaaacauuuguaauaaagaacugaaggcauauaucaacgagcuugucgaaaaacauuucaauacaaagcagaugcuggcucacuucaaauccauaaacuacagguggaaucggcaaaacguggagaagguugaaguguggcaguauucugacgagaaagagcguauggccgcaacucgcaagccguuggauaccagcuuugacaagaaacgaauugaaacgaucaccgauacaggcauccagaagauucuccugaauuaccuagaggaaaaagguggggaccccaacauagccuucacuccugagggcaucgcugagaugaauaagaacauuucacuguuuaaugauggaaaacuucaccaaccaauccucaagguaagagucgcgaagaccaugggcgccaaauaucagguggggcagacaggaaacaaggcagcuaaauacgugggcgcccaggaagguacuaaucuguauuucgccauuuacgagaacgaagagggggaaaggaguuacaacgcuguccccuugaaugagguugcagagcggcugaagcaaggaauguccccugugccagagaaaaacgaaaaggacguacccuuaaaguuuuaucucucuccgaaugaucugguguacgucccuaccgaagaggacaaacuuagcaacgaaugcaagcuggauaaugagcgcaucuauaaaaugguguccgccacgggcaagaaaugucauuucuugccauacucaguugcgaacauaaucuauaauaagguggaguuugaaagcaugaacaagauggguaaagcucucaguggcgagaugauuaaggccgucugcuggaaacuggaaguggacagacuagggacaauccugaggguuauuaaguga

SEQ ID NO: 3399 - RNA, 4452 nt, Artificial Sequence
  Cas9 variant
augaagaccgagcuggaccucaacaaagauagacuuuacaagcacgugcugggcuuggacuuaggggucacaagcaucggauucgcccauguuguggaauccgagaauaggaacgaaucugagauuaaacagauagguguacgggugauccaacuggauaauuuugacaaggucgauaaaucaggcaagacuuccgaaagcaagaaccccgcuguggacuucgcagccgggaaaggacuaacgccuaauggcucccgcaccaagaaacgaggugcgcguagaaaccucgauagguaucaggaccggcgcgauaaucugcuugagguucugacaaagucuggguuuauuaacucggagacuaaaagaaccgaagacggaaagcacacaacccaucagacuugggagaucagggcuaaggccgugucagaaaaagucgagaaggaggaguucgcacggauuuugcucgccaucaauaaaaagcgcggcuacaaaagcagucgaaaggcuaaaaacgaagaugaaggccaggcaguggacgggauggccguagcuaagagacuguaugaggaaaaucugacaccaggacaauacgccuaugagguucucuccgguggcaagaaaucuauaccggauuuuuacaggagcgacuuacaggcggaguucgacaagaucuggaacuuucagaaacaguucuaucccaauauucugaccgaugaauuuuacgaggaacuuaaggggaaaggacaacgggcaacguccgccgcuuucuggaagauccaccaguuuaacacugccgacauuaaggauuuggaggacgaacugaaaaaugagcguaccaucaagcuaucaaaacgcgaucagaagaaacuccaggcauacaaguggagaagugaggcuguggucaagcaacugggcaaagaagagguggccuaugugcuuacagaaauaaacaacaaucugaacaauagcucugguuacuugggggcgauuuccgacaggucaaaggagcucuauuucaacaaacagacugucggacaguuucuguacaagcaauuaaaagaaaauccucauacccggcugaagaaccagguuuucuaucgacaggauuaccucgacgaguucgagacaaucugggaaaugcaggcccaauuucacccagagcuuacccaggaacugaaggaggagauucgcgauaucaucauuuucuaucagagaaaacuaaagagccagaaaggccuaauaaguuuuugcgaacuggagucuaaggaagugguaaucaaugacacgaaaaagauuaucggccucaggguggcacccaaauccagcccucuguuccaagaguuuaagauauggcagaaccuuaauaacguccuggugcggaagaaagggucgcgcaagagaaugguuaaagcucagaaucagcacucuuuguucgaggaaccaaaggagauuuuuagucucgaucuggccucaaaagaaaaguuauucgaggaacugaaccuaaagggaaaucucagugcuaaaaacugucuggacauccuugguuugaauagcaacgagugggaacugaacuacacucaacucgagggcaauaggacaaacaagucccuguacgaggccuuucuuaaaauccuggacauugaaggguaugaugugaaggacuugcucaaagucaagucuagcaaggaugagguggaacuggacgauuuaaaaguacccgcaucagagaucaagaauaugguucgugaaauuuucaguaccaacaaaauagacacugagauccuggauuuugacgccgagauugauggaaaggcuuucgaaaaacaguccagcuaccagcuauggcaucuccuguauucuuacgagggcgacgauucacagagugguaaugaaaaacuuuaugaguugcuggcgaagaaauuuggguucaagcgggagcacgcacaaauccucgccaacgugagccuggucgacgauuacggcaauuuauccucuaaagcuaugcgaaagaucuauccucauauuagagaaaacaauuacucgacagccugcgagcuggugggauacaggcacagcaaacacucccuuaccaaggacgaauugaaagaccgcguccucgaggaucggcuggaacuacugaagaagaacucacucagacagccagugguugagaaaauacugaaucagaugaucaacgcagugaaugcccuuauugagaagaacagugaaagggacgagaauggcaacaucacgaaauauuucaaguuugaugaaauucgcaucgaguuggcucgagaacugaaaaagaacgccgcagagcgggcggagaugaccacaaauauaaacgcugccaaguuaguacaugaaaagaucuucaagauucuccaaaaugaguuugggaucaaaaacccgacucguaaugacauuaucagauacaggcuguaugaggaacuuaagggaaacgguuacaaagaucuguauucuaauaccuacauaccccgcgaaauuuuguucagcaaccagaucgacauugaucacauccucccucagucccggcuguuugacgauucauucagcaauaaggucgugguuuuuagaaaggacaacuugaaaaagggcaaucagacagcaauagauuauaucgggucugaggugggagaggaaggccugaaaaacuucauugagagggucgaaucccucuacgagcuggguaagaaaaauaaggaggaagggaucaguaaggccaaauaccaaaaacuuuugaaaagcgcuucugagauuggcgacggauuuaucgaacgagaucugcgcgagucccaguauauagccaagaaagcaaaggaauuacucuucaaggugacucggucaguagugaguaccagcggcucgauuacagacagacugagggaggacugggggcuuaucaacguuaugaaagagcugaaucuaccaaaguacaaaucccucggacugaccgaaauccaggagcgucgcaacggucaucaggucgaagugauuaaggauuggacuaaacggaacgaccacagacaucacgcuauggaugccuuggcgguggccuuuacgaagcacaaucauauccaauaucugaacuacuuaaaugcuaggaaaaacgagucucacaagcuccauggcaauauuauagcaaucgaaacacuggagaccgaggucaagauugacgaucuugggaacaaaaagcgaguuuucaaagaacccaucccuaauuuucgccagguggccaaggagcaccuggaaaacguguugauuagccacaaagcuaagaauaagguagucacuaaaaacaagaauaaaaucucaggaaaggagaaacuccagauaacccugacaccacggggccagcuacauaaggaaaccguguaugguaaguacagauucuaucaaaguaaagacgagaagguuuccgccaaauucgaucuggagacuaucgaaaagguggcaaaccccucuuacaaagcggcccuucuccagaggcugaaugagaacgaaaaugacccgaagaaggcuuuuagcgggaaaaacgccuuguccaagaauccuauuuacaucucaauggagaacgauauuaaaguccccgacacagugaagcugguuugguuagaggaagauuauagcauccggaaagacgugacgccagagaacuucaaggacgaaaagaguauagagaagauucucgaugaaggcguaaagcgaauccugaaaaauagacuuaaggaguuuggaggcgacgcaaaagaggcuuucucugaucuggacaagaacccuaucugguugaaugaagagaaagggaccuccauuaagcgcgucaggauaagcggagugaagaacgccgaaccccuccacuacaaaaaggaucauuuuggcaaugacauccuggaugguaacgggaauaaaauuccagcagacuucgugucgacuggaaacaaucaccaugucgccaucuauaaggagcccgaauuugauaaaaagggccagccuguucuagacgagcuggguaaccaaaaguacaaucuucaggagaaagugguaucauucuuugaagcuguggagcgugucaaccagggccucccaauuaucgauaagacauauaaucagcaccugggguggcaauucuuuuucaccaugaaacagaacgaaauguucguguuuccgaaugagaagacacgguucaaccccauagaaaucgacuuguuagauccuaacaauaaaaagcugauuucucucaaccuguuuagaguucagaagaucgcgaauaaaaacuacauguucaggcaccaucuugagacuaauguggacgacaagaaagagaugaagaacauugccuuuauccacauacagaguuguaaucuguugaaagaaauuaucaagguccgccuaaaccaucugggagauaucguguccguuggcgaguauuga

SEQ ID NO: 3400 - RNA, 4452 nt, Artificial Sequence
  Cas9 variant
augaagaccauccugggccucgaccuugggacaaacagcauuggaugggccaaaguguccgucgaugaccacgguaauuaccugcaugauauaaaguugggcucuagaaucauucccaugucacaggacaucuuagggaacuucgauaaaggaguuacugagagucaaacggcuauuaggaccggcuuucggagcgugcgccgaauccgugaaagaucccugcuaaggcgggagcgccuccacagaguacugcaugugauggguuuccuuccuccacacuaugacucugcaauaggguggaauagggaagaggccucgacauacggaaaguuucugaaccauggcgaaccgaaauuggcgugggagcggcucgaggauggcucaaugcgcuuccuguuuauggacagcuuccacgaaaugauggcuaauuuugcccgacaccagcccgcacuggucgccgaugggagaaagaucccucucgacuggacuuuauauuaccugaggaagaaagcucuuagucaggcagugggaaaggaggaauuggccuggauucugcuaaacuucaaucagaaacgggguuauugccaacuccguggcgaggaggaagaggaaaccccaacaaagcgcgaggaauacuaugagcugaaaguuguguccgucgaggcugccgaagaggggaagggaggcaacaccugguacagagugcagcuugaaaaugguuggaucuacaggcggcccucuaagauugcgcuggaugacuggguagggaaaacuaagcaguuuaucguuacaaccgaguaugaaaaagauggaacgacuuugaagaaagacaaggacggcgaggugaaacgauccuuccgcgcaccuggcgagaacgauugggggcucagaaagaagaggaccgaaucccagcuggaggccucaggaaaaacagucggugcuuuuauauacgaccauuuacuggccgaaccagcagauaagauucggggcaauuucauccgcacuauugagagaaaauauuacaagcaagaacucgaggcuauccuuagggagcagaccaaacaccaugaagaacugcguaguaaggaaauguuggccaagugugcggaggagcuauaucagagcaaccagccccaccggaaaucucugcucaauaaggacaugacauaccugcuucugaccgauuugaucuuuuaucaacgaccucucaaauccaagaaaucacugauugccgaaugcccauacgaguacuauaaguacaaggacaaagaaaaggggaaaaagaaaagacagggaauaaaguguguggcaaagagcaacccguauuaccaggaguucagguuauggcaauucaucgugaaucugcgccuauuugaucggacggacgauaaagaagucacugcugaguaucucagaaguagggaggacuacgcccgccuguucgcuuaucuuaacgaucgaaaggaaauuaaccaggagacauugcugaaagacuuuuucggccucaagaaaguuaagaucggugccgaaaaagaguuugcaauacgguggaauuacauugaagacaaggagaagaaauaccccugcaacgagacccgucacgaacugcuucuggccuuggauagagcugggauggacaggucuuggcucgaugacuccgagcugcaguaucgcuuauggcaucugcuauacagcguggaagcgcgggaugaggcagaaggcgcccucagaaagcugagggacgaugacgaguucguaggagcuuuucuuaaagugaagccuuucaaaaaggauuauggcgccuacucggagaaggcagucaaaaaguugcuggccgugaugcgaauggggucuugguggcacgaagaggacaucuguaaacagacucgcgaucggaucgaaagaauuguucaaggagacaucgaggagaagauuagggaacguaugggucaugcugccuauuccuuuucacgccucgcagauuuccagggccugccagagugguuagcgugcuacguggucuaugggcggcacagugaagcuacacauauacugagaugggacagccccgacaaacuuuuguccuacaucaagggauuuaggcagcacucucuccgaaauccuauuguggagcaguguauccuggaaacccuacggacgguacacgauaucuggaaggaggccggccauauugacgagauacacguugaacugggucgcagcaugaaaucaaccgcagagcaaagagcccauaugacaaagaacauccucaggaaugaaaacacuaaucugcggauuaaaugccuuuugauggagcugaagaacgaugcugacgugaaagauguccgaccauacagucccaugcagcaggaaaucuuaagaauuuaugaggagggggcccuccagcaacugaccaaggacgaugcagaauacgcugagaucuccaagauaagcaaaauggcccagccgucugcgaaggaacuucugcgcuauaaauuguggcucgagcagaaguacaggucaccuuauacaggcaaacccaucagucugagcaagcuauucacuuccgccuaccagauugaacacgugaucccacaaucucguuauuuugacgauucguucaauaacaaagucauuugugagagcgaggugaauacccugaaguccaacaugcucggauacgaguucaucaagaaucacugcggcgagauaguucauuguacaaugcugggggacgugaaaguauuuucagaaagugaguacaaggcuuucgucaccgagcacuauucuaacaauaaauacaagaaagaaaaacuuuugcuggaggauauuccucaggaauuuuuaaaccggcagaugaacgacagcagauauaucuccaaggugguuaagggacuccugucaaauguggucaggacugaggaugaacuugaggcaacgagcaaguucgugguaucuugcacagguggcauuaccgaccgccugaaaaaggacugggggcuaaacgauguguggaauagcaucguuuacagucgauuugagagacucaacggacugacuaaaagcgaacauuucggccacugggagaauaaggaagguaagcgggucuuucaaaccucugugcccauggaguugcagaggggguucaacaaaaagcgcauagaccaucgucaccacgccauggaugcucuggugaucgccugcgcauccagaaauauuaucaacuauuuaaauaacgaauuugcgaaaucaccaaagcagcgggaggaccucaggcagcugcuuugugauaaaaaucgcauuauccgaaagcccugggagacauucacccaagacgccagagcugcccuggaagaugucguugugaguuuuaagaacuacgugcggguaauaaauaaaacuacaaacuauuacgagagguacgacgcagauggcaagaaaacgauggucccucagaagggaaaugaaaugugggcugugcgcaaaccaaugcaugagggcaccauguaugggagaguuaacuugaggcggaaggccguggucaagcucaaagaagcacuggagaacauuagcucgaucugcaauaaggagcuacgugacuacaucaacgugcugguugaaaaacaguucaauacuaagcagcuucucgcccacuuuaaauccauggauuaucgcuggaacaagcaacauauugacaaaguggagguauggcgauucucugacgaaaagguccagaugguggcugcgagaaagccgcuggauaccagcuucgacaaagaguguaucgccucaauuacagauacaggaauacagaagaucuugcugaauuacuuagagaguaaaggcggugaccccgcaauugcuuuuacuuccgaagggaucgccgagaugaaccagaauauugccguguauaacgauggaaagaaacaccaaccugucaucaagguuaggaagucuaccaaacucggcaagaaauucgcugugggucagauaggcugcaagagcaaacaguuuguaguggcagaagccgggacgaaucuguacuucgcgaucuaugaggacgaagagggaaagcgguccuacgauaccauuccacuuaacgaggucacagaacgccugaagcaaggcuugucacccgugccugagaaaaaugaaaaggagguuccacucaaauuuuaccugagccccaacgaccuaguguaugucccgacugaagaugagaugcagaugaaggaguguaaacugaauaaggaaagaaucuacaagauggugaguucuaccgggaacgagugccauuuccuuccuuauuccguugcuagcgugauuuacaauaaagucgaauuugagucgaugaacaagaugggaagggcccucacaggcgaaaugaucaaagcaguauguuggaagcuggacguggaucgguuggguaacauauuacgaguuauuaaauga

SEQ ID NO: 3401 - RNA, 4452 nt, Artificial Sequence
  Cas9 variant
augaagaccauccugggccucgaccuugggacaaacagcauuggaugggccaaaauauccaucgaugacaaugguaacuaccugagagauauucaguugggcucuaggaucauucccaugucacaagacguguuagggaauuucgauaacggagucacugagagucagacggcuguucggaccggcuuucgcggucugcgacguaucagagaaaggagccuacuccggcgcgagagacugcacagggugcuucauguaaugggguuccugccuccacacuaugacuccgcaauaggauggaauaaggaagaaccgacaacuuacggcaaauuuuugaaccauggcgaacccaagcucgccugggagcggcagggggauggaucuaugcgcuuccuguuuauggacucguuccacaaaaugauggaggauuuugcgccucaucagccagcucugguggccgacggucgaaagaucccccucgauuggaccuuauauuaccugagaaagaaagcacuuacacaaccuauuaagaaagaagaguuggccuggauccugcuaaauuucaaccagaagaggggcuauuaccagcuccguggggaagaggaggaagagaauccaaccaaacgggaagaguaucacgaacugaaggucgugggaguugaggcugcagaggaaggcaagggugggaacacuugguacaaugugaaacuugagaacggauggauuuaccgcagaucaagcaagaucccccuggacgauugggucggcaaaacaaggccuuuuauagugaccacggaauaugaggccgacggcauuacuuugaagaaaaauaaggaaggggagguaaaacggaguuuccgagcuccaggagaggacgauuggggucucuggaagaagcgcaccgaaucccagcuggaggccucuggcaaaacaguuggggcguuuaucuacgaccacuuacuggcagaaccggccgauaagauuagaggaaacuucaucaggacuaucgagcggaaauauuacaagcaagaacucgcugacauucuucgcgagcagagcaaauaucaugaggaacugcaguccaagaagauauuggccgauugcgcagaggaacuauacagaucaaaucagccccacagggacagucugcucaaaaaggauaugguguaucugcuucugaccgacuugaucuuuuaccaacguccucucaaaagcaagaaaucucugauugcugauuguccauacgaguauuacgaguaugucgacaaggaaacaggcgagaucaagcggcaggguauaaaaugcauugccaaguccaaccccuacuaucaggaguuccgauuauggcaauucgugcugaaccuaagacucuacgauaggaccgaggacaaagaagugacggcggaguaucugccuucaaaggaggacuacgcccgccuuuuugucuacuugaaugaucggaaagaaaucaaccaggagacucugcucaaggacuucuuuaagcugaaaaagguuaaacagagaagcgaaaaggauuucccagugagguggaauuauaucgaggacaaagaaaagaaauaccccuguaacgagacacgccaugagcuucugauggcauuggaucgagcugggauugaacggaguuggcucgacgauaccgcccgucaguauagacuguggcacuuacuguacucuaucgagguaaaggacgaagcugagagggcccuacgcaagcucaaagaugacgaugaauuuguguccgcauuccugaaggucaaaccguuuaagaaagacuauggcgccuacagcgagaaggcugugaagaaacuuuuggcgguuaugcggaugggaucgcacuggugcgaggaugacauuuguaaggaaacuaaagagagaauagaacauauccugcaaggcgacgugggggagaagauuaaagagaggaugaaucacacagcauauucucucggagaacuguccgauuuccaggccuuaccugaguggcuggcuugcuacgucguguacggucgacauucagaagccaccgacaucaagcacuggaagacgcccgagagucuuauggcauauaucaacggcuuuaaacagcauagcuugcgcaauccaauuguagaacaguguauacucgagacccugcggacaguucacgauaucuggaaggaggccgggcacauugacgaaauccauguggagcuaggaagauccaugaaaucuacuagcgaucaaagggcucguaugaccgaaaacauucugcgcaaugagaacacaaaucuccggaucaagucacugcuuauggaauugaaaaacgacgccgauauaaaggacgucagaccuuacagucccaugcagcaggagauccugaggauuuaugaggaaggcgcauuacaggagcucacuaaggaagauaaugacuacgaggaaaucuucaaaauuuccaagaugccacaacccagcgcgaaagagcugcuuaaguauaaacugugguuggagcagaaguaccgaucuccuuauaccgguaaaccaaucucacucaguaagcuguuuacaagcgcuuaccagauagaacacauuaucccgcagucccgguacuucgaugacucuuuuaacaauaaggugauuugcgagucggaagucaacgcccuaaaagggaacaugcugggcuaugaguucaucaagaaucauggaggcgagauagugcacuguacccuccugggggauguuaaagugcaaaacgaaagcgaguacaaggcauucguaacugaacacuaugccaauaacaaauacaagaaggagaaacuuuugauggaagacaucccccaggacuuucugaaucgccauuuaaacgauuccagauauauuucaaaggucgugaaaacgcuccugaguaauaucguuaggacagaggacgagauggaaaccacuucuaaguucguggucagcugcaccggagguauuacagaucggcuuaaaaaggacuggggccugaacgauguguggaacuccaucguauacucacgauuugagagacuaaaugaacucaccaagagcgacgcuuucgggcgcugggagaauaaagaaggaaagaggguguuucagacuucuguuccucuggaguugcaacguggcuucaacaaaaagcggauagaucacagacaucacgccauggacgcacuggucauugcuugugccuccaggaauaucaucaacuauuuaaauaacgagagugcgaacagccccaaaaagcgcgaagaucuccgacagcagcugugcgacaagaauagaauuauccggaaaccaugggagucuuuuacacaggaugccagggcugcacuugaagacgugguggucuccuucaagaacuacguucgcgugauuaauaaagccacgaacuacuaugagcguuacgacgcugaugguaagaaaaccauaacuaagcaaaagucaagagaaaugugggccgugcggaaaccuaugcauaaggagacaguauuugggcacgucaaucugaggcgcaaagcaaucgugaaguugaaagacgcgcucgagaacauuccaaguaucugcaauaaggaacugcgagauuauauuaacggccuaguugagagaaauuucaacaccaaacagcugcacgcccauuuucggagcacagacuacagguggaauaagcagaacguggauaaggucgaaguguggcgcuucucggacgagaaagagccccuuguugcuacuagaaagccgcucgauaccuccuuugacgccaaaaggaucgauacgauaaccgacacaggaauccagaagauucuguugaauuaucuggaagcaaaaggcggggauccuuuaaucgcuuucacuccagagggaauugccgaaaugaaccaaaauaucgcacucuacaacgacggcaagaugcaccagcccauacugaaggugcggauuucugagccuaaaggugccaaguaucagaucgggcagaccggaaacaaagcugauaaguucguagaagcgcaaaaaggcacaaaucuuuacuuugccaucuacgaggacgaggaccguaaccgcacuuauaauaccauuccccugaacgaagucgcagagcgauugaagcagggucucccaccugugcccgaaaagaaugagaaagaagugccacugaaguucuaccuaagcccgaacgaucuggucuauguuccuacggaggaggaaauacuuaugaaagaguguaagcucaauaaaaacagaaucuacaagauggugucaaguacaggcaaucagugcuuuuucauucccuuuaggguagcuguguccaucgucaacaagauggaauauucuccacugaauaaaauggagaaggccauuagcuccgaaaugaucaaagccguguguuggaaguuggagguugaccgguuagggaacauaauccgcguggucaaauga

SEQ ID NO: 3402 - RNA, 4458 nt, Artificial Sequence
  Cas9 variant
augaagaacauccugggccucgaccuugggaccaauagcauuggaugggccaaaauauccaucgaugacaacgguaaguacauuaaagauucuaucaagcugggcucaagaauuauccccaugagucaggacguguugagcaauuucuccaaaggggucacauuaucucaaacuucggagaggacgucauuucggggagcucgccgacugcgugaaagaacccuacucaggcgggagcgccugcacagaauacuucaucuguugggcuuccucccuaagcacuaugaaaaggcaaucgguugggauaggaacgacaauaaaacauacgggaaguuuauuaaccaugccgagccaaaacuggcguggugcaaggauaauaacggaaaaaugcgguuccuguuuauggacagcuuccacgauaugcucagugaauuuuccgagaagcauccggaguuacuggcuaauggcaagaaaaucccccuugacuggacuauuuauuacuugcgcaagaaagcccuguauaaggcaaucaccaaagaggaacuagccuggauacuccugaacuucaaucagaagcgaggcuacuaucagcuuagaggggaagaggauagggacucugaggcuaacaaaaaggaauaccuggaguugaagguuauuggaguggaagcaacaggugagaaaaagggcaaugauaucugguacaacauucaccucgaaaauggguggaucuaucggcguagcuccaaaaacccucugaacgacugguuaggaaagguaaaaucauuuaucgugaccacugaccuggaugccgacggcaauccaaagaaggauaaagacgguaacauuaagcgcaguuucagagcucccagcgagggggauuggacacucaucaaaaagaggaccgagucucuucuggaaaauuccggacagacggucggccaauuuauauacaaccacauuuuggaggaaccuucagccaaaauccggggcaauuucauacgaacuauugagcgcaaguauuacaaggacgaacuaaaagcgauccuggagaagcagaaagaguuucaucacgaacucagcagugagucucugcuuaccgaaugugcaaaggagcuguauaaaagaaacaucgcccaucaggaaguguugcucaagaaggggaugauucaccuguuacugaaugauauccuauucuaccagaggccacucaaaauuaagaaaucccugauagacaacugccccuaugagaauuacaaguacguugauaaaaagagcggagacaucaaagugaagucgauuaaguguaucgcuaaaucuaacccuuucuuucaagaguuccggcuuuggcaguuugucuccaauuugcgccuguauagaaagucagaugacaaagacgugacaagugaacaccucguaacuaccgaugacuacgccaaccuguucacauaucuuaauaacaggaaggauaucaaacagagcguucuguugaaggaguacuuuaagauuaaaaaggugaaaaccauaaauggugcagaauauccaguccguuggaacuacaucgacgaugacaacaagacguauccgugcaaugagacucgguacgauauucuccaugcucuguccaaaacagaguuaaagucugaauggcugacccccgagcgaacuuacagacuauggcaccuccuguauagcaucgaaucaaaggaggaaaccaaaaaggcccuuaacaaauugaaucugagugacgauuucacagaggcguuucucacgauuaagccuuucaaaaaggaguacggcuccuauagcgaaaaggccaucaaaaagcuguuaucucugaugaggaugggguaccuuuggucagaggacgaagcaauaaaacaggugggagcugagaucgaaaagaccauugagggcgaguugccagauuaugugcuccaacgccuggaaaaaucacagcauaacuacaauaagaucagcgacuuuuccggucuaccccuguggcucgccucuuauauuaucuacgggcggcacucggaggcuaaagaaauaauucauugggauaacccugagagcaugauggccuacaucaaggacuucagacagcacuccaugaggaauccaauugucgaacaauguguucuggagacacuucgcacugugcacgacaucuggaaggagauaggccauaucgaugaaauucacaucgaguugggacgagaaaugaaaucaaccagugagcagcggaaggcaauuacacagaacguacugcauaaucagaacacuaauauccguauaaaauuacuccugcaagagcuuaagaacgacaauaacauuaccggcgugagacccuauucuccgaugcagcaggaaauccugaggaucuacgaggaaggggccuugcagggacucacaaaagaggauaaggacuauaaugauauucugaagaucagccaaaccgcucagccuacuuccaacgaacuaacgcgcuacaaacuguggcucgagcagaaguaucggucacccuacacagguaaagcgauuagccugucuaaacuuuuuaccuccgcauaucagauagagcacgucaucccacaaaguagauacuucgacgauagcuugucuaacaaagugauuugcgaauccgagguuaauacucugaagaaggccauguuaggcauggaauuuaucaaaaccugugggggacagaaggugcacugcacacuccugggcgacgucgagauuuacaacgaagaggauuauaaggcuuucgugaaugagcauuacucaaacaauaggaccaagcgaaacaaacuucugauggaagacaucccucaggaguucauaaaucgccagcuaaacgauagucgguauaucagcaagaugguaaagcaacuccugucggccauuguuagaggucaggaagagguggaagcaacuuccaaauuugucauccccuguacagggggcauuacggacagguugaagaaagauuggggacugaaugacaucuggaacaauuuagugucuccacguuuccagcgcaugaacgcccucaccggcagcgaguacuuugggcacugggagaauaaggaaggaaaacgggucuuccaaacuacaaugcccauacagcugcagcaggguuuuucaaagaagagaauugaccauaggcaccaugcuauggaugcccuugugaucgcaugcgcgagucgaaacaucauuuccuaucugaauaacgagaccgcucaagacacagaacggcgcagagauuugaggcagaaacucugugacaagggcgggucuguucggaaaccuugggauagcuucacucaggacacccaguacgcccugaaggauauaaucgugacguuuaaaaacuauguacgaauuaucaauaaggcaaccaacuacuacgagcacuauaaaacagacggaaagaagggcaugauuucccaaaaaggugaugagcuaugggccaucagaaagccaaugcacaaagaaacugucuucgggaaggugaaucugcgcaggccgaaacguguuucacuuagcaaggcuauagacaguguggaugucaucugcaaccggaagcucaaaaaguacauuaaagccagacugaaugagggcuugcagaagaaacagauccugaacauuuuuaaggaagugaauaacguaugggagggaaucgacgugaauaagauagacauuugggaaaugucuaacgauaaagagcccaugguugcaaccaggaagcaguuagacacauccuucgaugagaaaaagauccgcagcaucucggacacuggcauucagaaaauccuccugaauuaucuuauaaccaagaacaauaacccugaacuggcuuuuacgccagaggggauucaagaaaugaauaguaacaucucugaguacaaugaucauaagaaacaccagcccauuuauaagguccgagugacagaaccuuugggagccaaauacccaaucggcaccauggguaacaaccccaagaaauucguggaggcgcaagccgggacuaaucucuauuuugcuauauacgaggacaaggaaggaaacagaaauuacgauacaauuccgcugaacaucgcagccgagcggcuaaaucagcagcugaguccugucccagaaaccaacgagaauaacacuccccuuaaauucuaucucuccccuaaugaccugguuuacgugcccagcgaagaggagaggcauucuggcaacaauauccaguuggauaagaaccgcauuuauaagauggugagcuccaccucaaaacaaugcuucuuuauccaccaucguguagcuauuaguuuagucgacaagaaagaguucagcgcccagaauaagauggaaagaucuauagauaacgaacaggugaugaucaaauccguuuguuggaagcugauuacagaccggcucgguaauaucaucaaggugauuaaauga

SEQ ID NO: 3403 - RNA, 4458 nt, Artificial Sequence
  Cas9 variant
augaagaacauccugggccucgaccuugggaccaauagcauuggaugggccaaaauauccaucgaugacaacgguaaguacauuaaagauucuaucaagcugggcucaagaauuauccccaugagucaggacguguugagcaauuucuccaaaggggucacauuaucucaaacuucggagaggacgucauuucggggagcucgccgacugcgugaaagaacccuacucaggcgggagcgccugcacagaauacuucaucuguugggcuuccucccuaagcacuaugaaaaggcaaucgguugggauaggaacgacaauaaaacauacgggaaguuuauuaaccaugccgagccaaaacuggcguggugcaaggauaauaacggaaaaaugcgguuccuguuuauggacagcuuccacgauaugcucagugaauuuuccgagaagcauccggaguuacuggcuaauggcaagaaaaucccccuugacuggacuauuuauuacuugcgcaagaaagcccuguauaaggcaaucaccaaagaggaacuagccuggauacuccugaacuucaaucagaagcgaggcuacuaucagcuuagaggggaagaggauagggacucugaggcuaacaaaaaggaauaccuggaguugaagguuauuggaguggaagcaacaggugagaaaaagggcaaugauaucugguacaacauucaccucgaaaauggguggaucuaucggcguagcuccaaaaacccucugaacgacugguuaggaaagguaaaaucauuuaucgugaccacugaccuggaugccgacggcaauccaaagaaggauaaagacgguaacauuaagcgcaguuucagagcucccagcgagggggauuggacacucaucaaaaagaggaccgagucucuucuggaaaauuccggacagacggucggccaauuuauauacaaccacauuuuggaggaaccuucagccaaaauccggggcaauuucauacgaacuauugagcgcaaguauuacaaggacgaacuaaaagcgauccuggagaagcagaaagaguuucaucacgaacucagcagugagucucugcuuaccgaaugugcaaaggagcuguauaaaagaaacaucgcccaucaggaaguguugcucaagaaggggauuauccaccuguuacugaaugauauucuauucuaccagaggccacucaaaauaaagaaaucccugaucgacaacugccccuaugagaauuacaaguacguugauaaaaagagcggagacauuaaagugaagucgaucaaguguaucgcuaaaucuaacccuuucuuucaagaguuccggcuuuggcaguuugucuccaauuugcgccuguauagaaagucagaugacaaagacgugacaagugaacaccucguaacuaccgaugacuacgccaaccuguucacauaucuuaauaacaggaaggauauuaaacagagcguucuguugaaggaguacuuuaagaucaaaaaggugaaaaccauaaauggugcagaauauccaguccguuggaacuacauugacgaugacaacaagacguauccgugcaaugagacucgguacgauauccuccaugcucuguccaaaacagaguuaaagucugaauggcugacccccgagcgaacuuacagacuauggcaccuccuguauagcauugaaucaaaggaggaaaccaaaaaggcccuuaacaaauugaaucugagugacgauuucacagaggcguuucucacgaucaagccuuucaaaaaggaguacggcuccuauagcgaaaaggccaucaaaaagcuguuaucucugaugaggaugggguaccuuuggucagaggacgaagcaauaaaacaggugggagcugagauugaaaagaccaucgagggcgaguugccagauuaugugcuccaacgccuggagaaaagucagcauaacuacaauaagauuagcgacuuuuccggucuaccccuguggcucgccucuuauaucauauacgggcggcacucggaagcuaaagaaauuauccauugggauaacccugagagcaugauggccuacauuaaggacuucagacagcacuccaugaggaauccaaucgucgaacaauguguucuggagacacuucgcacugugcacgacauauggaaggagaucggccauauugaugaaauccacauugaguugggacgagaaaugaaaucaaccagugagcagcggaaggcaaucacacagaacguacugcauaaucagaacacuaauauacguauuaaauuacuccugcaagagcuuaagaacgacaauaacaucaccggcgugagacccuauucuccgaugcagcaggaaauccugaggauuuacgaggaaggggccuugcagggacucacaaaagaggauaaggacuauaaugauauccugaagauuagccaaaccgcucagccuacuuccaacgaacuaacgcgcuacaaacuguggcucgagcagaaguaucggucacccuacacagguaaagcgauaagccugucuaaacuuuuuaccuccgcauaucagaucgagcacgucauuccacaaaguagauacuucgacgauagcuugucuaacaaagugaucugcgaauccgagguuaauacucugaagaaggccauguuaggcauggaauuuauuaaaaccugugggggacagaaggugcacugcacacuccugggcgacgucgagaucuacaacgaagaggauuauaaggcuuucgugaaugagcauuacucaaacaauaggaccaagcgaaacaaacuucugauggaagacauaccucaggaguucaucaaucgccagcuaaacgauagucgguauauuagcaagaugguaaagcaacuccugucggccaucguuagaggucaggaagagguggaagcaacuuccaaauuugucauucccuguacagggggcaucacggacagguugaagaaagauuggggacugaaugacauauggaacaauuuagugucuccacguuuccagcgcaugaacgcccucaccggcagcgaguacuuugggcacugggagaauaaggaaggaaaacgggucuuccaaacuacaaugcccauucagcugcagcaggguuuuucaaagaagagaaucgaccauaggcaccaugcuauggaugcccuugugaucgcaugcgcgagucgaaacauuauauccuaucugaauaacgagaccgcucaagacacagaacggcgcagagauuugaggcagaaacucugugacaagggcgggucuguucggaaaccuugggauagcuucacucaggacacccaguacgcccugaaggauaucauugugacguuuaaaaacuauguacgaaucauuaauaaggcaaccaacuacuacgagcacuauaaaacagacggaaagaagggcaugaucucccaaaaaggugaugagcuaugggccauaagaaagccaaugcacaaagaaacugucuucgggaaggugaaucugcgcaggccgaaacguguuucacuuagcaaggcuaucgacaguguggauauuaucugcaaccggaagcucaaaaaguacauuaaagccagacugaaugagggcuugcagaagaaacagauccugaacauauuuaaggaauuaaauaacgucugggagggaauugacgugaauaagaucgacaucugggaaaugucuaacgauaaagagcccaugguagcaaccaggaagcagcucgacacauccuucgaugagaaaaagauucgcagcaucucggacacuggcauacagaaaauucugcuuaauuaucugaucaccaagaacaauaacccugaauuggcuuuuacgccagaggggauucaagaaaugaacucaaauaucucugaguacaaugaucauaagaaacaccagcccauauauaaggugcgaguuacagaaccucucggagccaaauacccaauuggcaccauggguaacaaccccaagaaauucgucgaggcgcaagccgggacuaaucuguauuuugcuaucuacgaggacaaggaaggaaaaagaaacuacgauacaaucccgcuaaauauugcagccgagcggcugaaccagcagcuuaguccugugccagaaaccaaugagaacaauacuccccucaaguucuaucuguccccuaacgacuugguguacguccccagcgaagaggagaggcauucuggcaauaacauccaguuagauaagaaucgcauuuauaaaaugguuagcuccaccucaaagcguugcuucuuuauacaccauagaguggcuaucagucugguggacaaaaaggaguucagcgcccaaaacaaaauggaacggucuauugauaaugaacagguaaugaucaaguccgucuguuggaagcucaucacagacaggcuggguaacauuauaaaagugaucaaguga

SEQ ID NO: 3404 - RNA, 4458 nt, Artificial Sequence
  Cas9 variant
augaagaacauccugggccucgaccuugggaccaauagcauuggaugggccaaaauauccaucgaugacaacgguaaguacauuaaagauucuaucaagcugggcucaagaauuauccccaugagucaggacguguugagcaauuucuccaaaggggucacauuaucucaaacuucggagaggacgucauuucggggagcucgccgacugcgugaaagaacccuacucaggcgggagcgccugcacagaauacuucaucuguugggcuuccucccuaagcacuaugaaaaggcaaucgguugggauaggaacgacaauaaaacauacgggaaguuuauuaaccaugccgagccaaaacuggcguggugcaaggauaauaacggaaaaaugcgguuccuguuuauggacagcuuccacgauaugcucagugaauuuuccgagaagcauccggaguuacuggcuaauggcaagaaaaucccccuugacuggacuauuuauuacuugcgcaagaaagcccuguauaaggcaaucaccaaagaggaacuagccuggauacuccugaacuucaaucagaagcgaggcuacuaucagcuuagaggggaagaggauagggacucugaggcuaacaaaaaggaauaccuggaguugaagguuauuggaguggaagcaacaggugagaaaaagggcaaugauaucugguacaacauucaccucgaaaauggguggaucuaucggcguagcuccaaaaacccucugaacgacugguuaggaaagguaaaaucauuuaucgugaccacugaccuggaugccgacggcaauccaaagaaggauaaagacgguaacauuaagcgcaguuucagagcucccagcgagggggauuggacacucaucaaaaagaggaccgagucucuucuggaaaauuccggacagacggucggccaauuuauauacaaccacauuuuggaggaaccuucagccaaaauccggggcaauuucauacgaacuauugagcgcaaguauuacaaggacgaacuaaaagcgauccuggagaagcagaaagaguuucaucacgaacucagcagugagucucugcuuaccgaaugugcaaaggagcuguauaaaagaaacaucgcccaucaggaaguguugcucaagaaggggaugauucaccuguuacugaaugauauccuauucuaccagaggccacucaaaauuaagaaaucccugauagacaacugccccuaugagaauuacaaguacguugauaaaaagagcggagacaucaaagugaagucgauuaaguguaucgcuaaaucuaacccuuucuuucaagaguuccggcuuuggcaguuugucuccaauuugcgccuguauagaaagucagaugacaaagacgugacaagugaacaccucguaacuaccgaugacuacgccaaccuguucacauaucuuaauaacaggaaggauaucaaacagagcguucuguugaaggaguacuuuaagauuaaaaaggugaaaaccauaaauggugcagaauauccaguccguuggaacuacaucgacgaugacaacaagacguauccgugcaaugagacucgguacgauauucuccaugcucuguccaaaacagaguuaaagucugaauggcugacccccgagcgaacuuacagacuauggcaccuccuguauagcaucgaaucaaaggaggaaaccaaaaaggcccuuaacaaauugaaucugagugacgauuucacagaggcguuucucacgauuaagccuuucaaaaaggaguacggcuccuauagcgaaaaggccaucaaaaagcuguuaucucugaugaggaugggguaccuuuggucagaggacgaagcaauaaaacaggugggagcugagaucgaaaagaccauugagggcgaguugccagauuaugugcuccaacgccuggaaaaaucacagcauaacuacaauaagaucagcgacuuuuccggucuaccccuguggcucgccucuuauauuaucuacgggcggcacucggaggcuaaagaaauaauucauugggauaacccugagagcaugauggccuacaucaaggacuucagacagcacuccaugaggaauccaauugucgaacaauguguucuggagacacuucgcacugugcacgacaucuggaaggagauaggccauaucgaugaaauucacaucgaguugggacgagaaaugaaaucaaccagugagcagcggaaggcaauuacacagaacguacugcauaaucagaacacuaauauccguauaaaauuacuccugcaagagcuuaagaacgacaauaacauuaccggcgugagacccuauucuccgaugcagcaggaaauccugaggaucuacgaggaaggggccuugcagggacucacaaaagaggauaaggacuauaaugauauucugaagaucagccaaaccgcucagccuacuuccaacgaacuaacgcgcuacaaacuguggcucgagcagaaguaucggucacccuacacagguaaagcgauuagccugucuaaacuuuuuaccuccgcauaucagauagagcacgucaucccacaaaguagauacuucgacgauagcuugucuaacaaagugauuugcgaauccgagguuaauacucugaagaaggccauguuaggcauggaauuuaucaaaaccugugggggacagaaggugcacugcacacuccugggcgacgucgagauuuacaacgaagaggauuauaaggcuuucgugaaugagcauuacucaaacaauaggaccaagcgaaacaaacuucugauggaagacaucccucaggaguucauaaaucgccagcuaaacgauagucgguauaucagcaagaugguaaagcaacuccugucggccauuguuagaggucaggaagagguggaagcaacuuccaaauuugucauccccuguacagggggcauuacggacagguugaagaaagauuggggacugaaugacaucuggaacaauuuagugucuccacguuuccagcgcaugaacgcccucaccggcagcgaguacuuugggcacugggagaauaaggaaggaaaacgggucuuccaaacuacaaugcccauacagcugcagcaggguuuuucaaagaagagaauugaccauaggcaccaugcuauggaugcccuugugaucgcaugcgcgagucgaaacaucauuuccuaucugaauaacgagaccgcucaagacacagaacggcgcagagauuugaggcagaaacucugugacaagggcgggucuguucggaaaccuugggauagcuucacucaggacacccaguacgcccugaaggauauaaucgugacguuuaaaaacuauguacgaauuaucaauaaggcaaccaacuacuacgagcacuauaaaacagacggaaagaagggcaugauuucccaaaaaggugaugagcuaugggccaucagaaagccaaugcacaaagaaacugucuucgggaaggugaaucugcgcaggccgaaacguguuucacuuagcaaggcuauagacaguguggaugucaucugcaaccggaagcucaaaaaguacauuaaagccagacugaaugagggcuugcagaagaaacagauccugaacauuuuuaaggaauuaaauaacgugugggagggaaucgacguaaauaagauagacauuugggaaaugucuaacgauaaagagcccaugguggcaaccaggaagcagcucgacacauccuucgaugagaaaaagauccgcagcaucucggacacuggcauucagaaaauccugcuuaauuaucugauaaccaagaacaauaacccugaauuggcuuuuacgccagaggggauucaagaaaugaauaguaacaucucugaguacaaugaucauaaggaacaccagcccauuuauaaaguucgagucacagagccucucggagccaaguacccaaucggcaccauggguaacaaacccaagaaauucguggaggcgcaagccgggacuaaccuguauuuugcuauauacgaagacaaggagggaaauagaaacuacgauacaauuccgcuaaauaucgcagccgaacggcugaaccagcagcuuaguccugugccagagaccaaugaaaacaauacuccccucaaauucuaucuguccccuaacgacuuggucuacguucccagcgaggaggaaaggcauucuggcaauaacauccaguuagauaagaaucgcauuuauaagauggugagcuccaccucaaaacaaugcuucuuuauccaccaucguguggcuauuagucugguagacaagaaagaguucagcgcccagaacaagauggaaagaucuauagauaaugagcaggucaugaucaaauccguguguuggaagcucauuacagaccggcuggguaacaucaucaagguuauuaaauga

SEQ ID NO: 3405 - RNA, 4461 nt, Artificial Sequence
  Cas9 variant
augaccaagauccugggccucgaccuugggacaaacagcauuggaugggccauaagagaggaugaaaaugagggugugaaccagaucauugacaaaggcgucaggaucuucuccgaagggguuaagucugagaauggaaaagaaauuucacgggcugcagagcgcacugccuaccgaagugcgcguaagaucaaauauagaaggaagcugcggaaguacgagacguugaaaguguuaagcguaaacggcaugugcccccuguccguggaagaggucgaacaauggaagaaaucugguuuuaaggaguauccucuaaauccagaguuccucaacuggcugcgcaccaaugaagauaaaaacauaaauccguacuuuuucagagacaaggcuucgaagcagaaagugacacuuuuugagcuggggagggccuuguaucacaucgcacagcggcgcggauuccucucaaaccgacuggaucagagcgccgaaggcguuuuugaggaacauaauccccaaauucagaaccugaucgaggaccucgauaguuccaauacuauuuuaaacgagcugaaggaauacuauaucaaucuuggcauaauugacgagucugaaaagagcggguucaagaaagauuuggacgagggagaaaagaaccugaaaaagcuauacaccucccucgugucaaucacaaagaaaaacgcuaaugauauugagaccuguaagcaggagcugaucgcaagacuuaacaaaaaggaagaccuggguaaagucaagggcgagaucaaggauauuagucaggccauguuggacgggaauuuuaaaacucucggacaauacuucuuuagccuguauaacaagacaaggauacggaaucaguacaccucucgugaggagcacuauuuagaagaguucaucauuaucugccagacgcagggcauagaggaaauuaacacuaaugagaaacugccugaaaagaaauuuaccggucucgcuaaggaccuuuaccgcgccaucuucuuccaaagaccacugaagucccagaaaggguugaucggaaaguguucauuugagaaaaacaagaguaggugcgcggugagccaucccgauuaugaggaguuccggauguggucuuaccuaaauacaauuaaaaucggcacucaguccgaaaagacccugcgauuucucacacuggaagagaaacuuaaacugguaccuaaguucuaucgcaaaaacgacuuuaauuucgaaguuuuggcaaaggagcucguggagaaaggcgccagcuuuggguacuacaagucgucuaaaaagaacgaguucuuuuauugguucaauuacaagccaaccgauuccgucucagcuuguguggugagugccagccuggaaaacgcaauuggaaaagacuggaagacgaaaacuuuugaauaucaaacauccaauaccaagaaagaggaagucacuaagucuguuaacuacaaggauuuauggcaucugcuaagcguggcuacaucagacaccuaucucuacgauuucgccauagagaaacugaaacuugagcccaaaaacgcgaaggccuuuaguaaaacgaaguugaagaaagacuucgcaucccugagccucgcugccaucgcuaagauucugccuuaucuuaaacagggucuguuguacucucacgccguauucaucgcaaauaucgaaaacauuguggaugccgacauauggaaggauaaagagcagcagaaguuuauccaaucaaagauugucgaccucaucgacaauuaccugguggaaaagaguaaguuagagauuaucaacugccugcuaaaaauauauaauaccgaagauaucgagggcagaaagguuuacuauagcaaagaggcugaaucccucuucgaggcggaccugaggaagaaacuugugccauuuuacaaggcaaacacaauuucugaacagcaggagcaggagaucauuuucaaggauuuguuuccgguccugaucgaacaacucaaaaagcaggaguucauaaaaauugugcggcuggacaagaaaaucgaagccuuuuuaaagggggagaaugaagagggacagauuuucuguaacuaucccgagaaguuuaaaaagcuguaccacccuucggauaucgaaguauucaaaaagaaaauaaucaaggacgaguggggcaaugaaaagguugugcuugguagcccauugacuaccuccauuaaaaaccccauggcuaugcgcgcccuccaccagcugagaaagguccuaaauacacugauccucgaugggcaaauugacgagaaaacuaggauccauauagaaauggcacgugagcugaacgaugccaauaagcggaaaggcauucaggacuuucagaaggagcgagaggaacuuuauaagaucuacgaagcuaaaaucaaggaguuguaccaggugaaaaccggaaaggaacuguuacacgucacagaugaggaccuccaaaaauucgagugggcccuggaacagaccaaggauggcagaauuaucacuaaggaggaacuuauuaaauauaagauaugggaggagcagaaccauaucugcauuuacacggggaaaacaaucucaauugacaguuuucugggagguaauccuaaguucgacaucgaacacaccauaccaaggucuaucagccaagauaacuccuugaugaacaaaacucucugugacaaggauuucaaucgcucagugaaaggcaagaagaugcccguugagcugagcaacuauaaugaaauucuaccgcggaucgcacacuggaaaaagcaggcggaggaacugaccagacagauugagacaaucucuagguccauaaaaagugcugccaccaagguggcaaaagacaagaacauucgcaagcgacauuaccucacucugaaacgggauuauauccaggggaaguacgaccguuuuacauggggagagccuaaaguaggcuucaagaauagccaaauccccgauacggguauuauaaccaaauaugcccaggcuuaccuuaagucuuacuuuaagagagucgaauccgugaaagggggcgccguugcagaguucaggaaguuguggggaauccaggaaucauuuauugacgagaacggcuucaaacacuuuaaggaaaaagaucgcaguaagcauacucaccauacaaucgacgcuauuaccaucgccugcaugccaaaggauaaauaugaccuguuagcgcacgccuggcggcucgaggaugagcagaauaagaaagcugcaaaggcccugauagaacaagcuaaaccuuggaagacauucaaagaggacaucgaaaagauugaggccgaaauccuugugagccacuuuacucccgacaacgucaagaaacaggcaaagaaaauucugagagugagggggaagaaacaguacguagcggagaucgagcgaaaugccaacggaaaggcuauaccaaagaaagaugccucggguaagauuaucuauaaacuaaaugaacgcggcaacaagauccccauucuccagcaaggggacaccauccggggaucccugcaucaggauucuauauacggcgcaauuaaaaauccuuugaacacgaaugagaucagauaugugauuaggaaggaccuggagagcuuaaaggcuaacgauaucgaaaacauaguugacgagaaugucaaagccaaggugaaagaagcaguggccaacaagauucuccugaucucaaguaauccacagcagaaaaacaaguucgcugaggguaagaaugucuggaugaacgaagagaaaaagaucccgauuaauaaaguucguaucuacgcgaacuccgugaagaaucccauugaaaucaaaaagcacucuacccuuagcaaauccaagcaugagcacaagcaaacaguguaugggcagaacgaugagaauuacgccauggcacuguacgaauuggacggcaaacgcgaguuugaacucauaaacaauuucaaccuggcuaagcuacugaaacagggacaaggcuauuacccucuucacaaggagaaagaaauuaaggggaagaaaguacucaucccaaucgagaagcggaauaacagagaugucgugcugaaaaggggacagcagguuguguucuaugacaagacugucgaaaauucaaaagauauuagcgaaauaguggacuuucgaggccggguuuacuugaucgagggucugaccauucagcgccaaaaggacaagaaaacagggaaggugaacgaauauggaaucauucaguuaagauacuucaaagaggccaggaagagugaagagaucucuaaagauuccuuuaagcccgacggcgaguucaagauaaacgaaaauaaaccuacucggaagaugaaccauaaucaguuuaccgccuucguagaggguaucgauuuuaaaguccucccaagcggcaaguuccagaaaauuuga

SEQ ID NO: 3406 - RNA, 4464 nt, Artificial Sequence
  Cas9 variant
augaagaacgugcugggccucgaccuugggagcaauuccgucggaugggcccugguuaaaaccgaggauaacgguaaucccaucggcucuauuaagauggggucaagaauaaucccuaugagucaggacauuuugggcagcuucgaaaaaggagauacagugucccaaacugcucagaggacguuauaccgggguaagcgccgacugaucgagcgucacguacuaagaagggaacggcucugccgcgugcugcauauuaugaacuuucuuccagaccacuucgauaaacuguuggggugggacaagaccgauaauaagacauauggaaaauuuaucgacgauucugagccgaagcucgcauggagacagaacaaaaaugaaaaggagaaaauggaguucgucuuuauggacucguuccaugaaaugcugucagauuuugccaagcaccagccccaacugauagcgaacggcaagaaagugccucucgacuggacuaucuacuauuuaaggaagaaagcucugacccagcuuauuagcaaggaggaauuggccuggauccugcuaaauuucaacaaaaagcggggcuacuaucagcuccgcggggaggaggaagaggaacagccaacaaagaaggaggaauacaagguucugaaagugauuagugucgaugcagacgagggacaaaaggguaauggcaucugguauaacauacaucuugaggacgggggaauuuacaaacgaaaguccgauacaccccuguacgacugggugggcaaaacuuugcagcucaucguaguuacaauuuaugaaaaggaugguaagaccccuaaaaucuuugacucugggaagcagaauccaagcuacagacugcccaaagaggaugacuggggauuaaucaagaaaaggacggaaucccagauucaaucaaguggcaagacugugggcgccuucauauaugauaacauccugagcaagccugacgauaaaauucgggggaaucucguccguaccaucgagcgcaaguacuauaaaaaggaacuuauagagauucugcagcagcaagcuaaauaccacgacgaguugcacaaccagaaccuacuggaaucuugugcaaaggagcucuaugcccauaaugaugugagauacaacgaaguggucaaguccaauaugauccaucugcuuguugacgacaucaucuuuuaccagaggccacugaaaucaaagaaaaguuugauugcuaacugcaaguaugagagcuacgaauauguggauaaagagacaggagagguaaaggaaaugccgauuaaauguauagccaagucuaaucccuacuaucaggaguuccggcucuggcaauuuauccacaaccugcgauuauccgacguggucacucgcgaagaugugaccgcgcaguaccugagcacaccucaggacuauugcaaucuauucaccuaccucaacgauagaaaggagauuaaacaggacauccugcuuaaggauuucuuuaaaaucaagaaaguucaaauugacaaggagaagguguucccaauagaauggaauuacaucaaagaugcaacgaagacuuaucccuguaacgagacaagguacgaauugcugucggcccucaaacgggcugguauggacaagcaguggcuggaugacaccccuaauaugcaguaucgccuuuggcaccuguuguacucugucgaggaacaggaggaguccgccaaagcacucagaaagcuguaugauaacgacaauuuugugucaaguuucuuaaagauuaaaccauuuaagaaaugcuacggcgcuuauagcgaaaaggccaucaaaaggcugcuaacucucaugcguauggggaaggcgugggacgagcaagccauugaugcaaagacacugaaauguauccagcagauaaucaccggaaacauugacuccaaacuuaaagaaaagaucgaugacucucgguacguauugcaccauguuagcgauuuccagggccugcccacguaccucgcuucauaugugauuuacggucgacacagugaggucaccgacaucagaugcugggauacaccgaaagaccuguuaaaguuuauauguggguucccucaacauucccugaggaaucccauuguggaacaggucauccuugagacuuugcgcgugguuuaugauauuuggaaagccgagaagcacaucgacgaaauacauguggagguagcucgggaaaugaagcucaccgcccagcaaagaaacgaggcaaaccugaggaaucuaaacaaugaagccacaaaccugcgcaucaaauaccuccuggaggagcuuaagaaugauacuuuuauuaaagacguccgaccauugagcccuaugcaccaggaaaagaugcggaucuaugagcaggcugugcugggcaacuuaaauaaacaggauaaggacuacgacgauauuaucaagauaucuaaaaaggaacgucccaccucagcggagcucauuagauauaaacuguggcuugagcaaaaguacugcaguccauacacaggaaaagcaaucagccuguccaaguuguucaccacugccuaucagaucgaacacguuauuccccagucuagguacuuugacaacucguucaauaacaaggugaucugugagagcgaagucaauaaagagaaggauaaaaugcucggcuaugaauuuauuaaggggcgcggaggugaccggauauacugcacggcucauggcaaagaggugacaauccugaaggaggaagaguauaagcaguucguaaacgaacacuacgcccauaauaaaagaaagagggauaaccuacuggcagagaauauuccugaauccuucucaagucgacaacucaacgacacccgcuauaucacuaaaaccauuaugucucugcuuagcaacgugguucggcagcagggggaggaggaagccacagcuaagaauuugcugccauccucaggagccgucaccgauaaauuaaagaacgacuggggccucaaggauguguggaauacuaucgugacaccgagauuugagaggcugaacaaacuuagcgguacgaaugacuucggggaaaugaaggaggaaaacggcaaucguuacuuucagaccaacguccccucugaguacgagaaaggauucaagaaaaagcgcauagaucaccggcaccaugcaauggacgcgcugguuaucgcuugcacuacaagaaauauggugaacuauauuuccaaugugaacgccaauaguccuaaacaaagggaagaccuacgacagcuccugugugauaagaaccggaucauuaauaagccauggaacaccuuuacacaggacgcauugaaagcccugaacgauaucguagucagcuucaagaauaacgugcgcauaauuaauagagcuacuaacagguaccaacgguaugacaaaaauggcaagaaaaugaucugcucucagaaggggaacgauaugugggccauccgaaaguccaugcacaaagagaccguuuuuggaagagugaauuuaauucgcaaggaagcacuccccauagcuaaagcccuggacaacaucucagcgauuuguaaugcccagcuuagggcuuacgucaacgaucugguggacaagcauuucaauaaaaagcaguugguugcacacuuuaagagucucgauuauaaauggaaccgucaagacgugagcaagguagaggucuggaucucguccgaugacaaaacgccuaugguggccgugcggaagccacuggauaccucuuucgacaaaaagaagauugcuagcaucacagacacugguauacaggccauccuacugaauuaccuugagucaaaaggcggggaugcacucgucgcguuugcccccgaaggcauucaggagaugaacaguaauaucgaacuguauaacaauggaaaggcucauaaaccgauuaagaacguuagauuguccgagacccugggugccaaauaccaggugggggaaaggggcgcaaagaccaaaaaguacguaguggcugacaagggaacuaacuuauucuuugccaucuaugaggaugaggaaggcaaacgcuacuauuacucugucccucuccgagaggcaauagaaagacaaaagcagaaacugagcccagugcccgaguauaaugaaaaggggguugcccuuaaauucuaccuguccccuaacgacuugguguauguccccaccgaggaggaacggacgaugggaacaugccacauugauaagaccaggaucuacaagauggugucaagcagugagaaucgcuguugcuucguuccaucuacuaucgcuaaagugauugcggacaaggucgaacuccugucccacaacaaaaucgagaaggccauaacaggcgaaagcauuaaagagguauguuggaagcuaaagguggaucgucuggguaauauccuuaacguuauuaaauga

SEQ ID NO: 3407 - RNA, 4464 nt, Artificial Sequence
  Cas9 variant
augaagaacgugcugggccucgaccuugggagcaauuccgucggaugggcccugguuaaaaccgaggauaacgguaaucccaucggcucuauuaagauggggucaagaauaaucccuaugagucaggacauuuugggcagcuucgaaaaaggagauacagugucccaaacugcucagaggacguuauaccgggguaagcgccgacugaccgagcgucacguacuaagaagggaacggcucugccgcgugcugcauaucaugaacuuucuuccagaccacuucgauaaacuguuggggugggacaagacagauaauaagacuuauggaaaauuuauugacgauucugagccgaagcucgcauggagacagaacaaaaaugaaaaggagaaaauggaguucgucuuuauggacucguuccaugaaaugcugucagauuuugccaagcaccagccccaacugaucgcgaacggcaagaaagugccucucgacuggaccauauacuauuuaaggaagaaagcucugacacagcuuaucagcaaggaggaauuggccuggauucugcuaaauuucaacaaaaagcggggcuacuaucagcuccgcggggaggaggaagaggaacagccaaccaaaaaggaggaauacaagguucugaaagugaucagugucgaugcagacgagggacaaaaggguaauggcauuugguauaacauccaucuugaggacgggggaauauacaaacgaaaguccgauauuccccuguacgacugggugggcaaaacuuugcagcucaucguaguuacaauuuaugaaaaggaugguaagaccccuaaaaucuuugacucugggaagcagaauccaagcuacagacugcccaaagaggaugacuggggauuaaucaagaaaaggacggaaucccagauucaaucaaguggcaagacugugggcgccuucauauaugauaacauccugagcaagccugcugacaaaauucgggggaaucucguccguaccaucgagcgcaaguacuauaaaaaggaacuuauagagauucugcagcagcaagcaaaauaccacgaugaguugcacaaccagcaucuacuggaaucuugugccaaggagcucuaugcucacaacgacgugagauacaaugaaguggucaaguccaacaugauccaucugcuuguugaugacaucaucuuuuaccagaggccacugaaaucaaagaaaaguuugauugacaauugcaaguaugagagcuacgaauauguggauaaagagacaggagagguaaaggaaaugccgauuaaauguauagccaagucuaaccccuacuaucaggaguuccggcucuggcaauuuauccacaaucugcgauuauccgacguggucacucgcgaagaugugaccgcgcaguaccugagcacaccucaggacuauugcaaccuauucaccuaccucaaugauagaaaggagauuaaacaggacauccugcuuaaggauuucuuucaaaucaaaaagguucagauugacaaagagaagguguucccaauagaauggaacuacaucaaggaugcaacgaaaacuuaucccuguaaugagacaaaguacgaauugcugucggcccucaaaagggcugguauggacaagcaguggcuggaugacaccccuaacaugcaguaucggcuuuggcaccuguuguacucugucgaggaaaaagaggaguccgccaaggcacuccgcaagcuguaugaugacgacaauuuugugucaaguuucuuaaaaauuaagccauuugaaaaaugcuacggcgcuuauagcgagaaggccaucaaaagacugcuaacucucaugaggauggggaaggcgugggaugaacaagccauugacgcaaagacacugaaauguauccagcagauaaucaccggaaacauugauuccaaacuuaaagagaagaucgacgauucucguuacguauugcaucacguuagcgacuuccagggccugcccacguaccucgcuucauaugugauuuacggucggcauagugaagucaccgauauccgaugcugggacacaccgaaagaucuguuaaaguuuauauguggguucccucaacacucccugagaaaucccauuguggagcaggucauccuugagacuuugagggugguuuaugacauuuggaaagccgaaaagcauaucgaugagauacacguggaaguagcucgcgagaugaagcucaccgcccagcaacggaacgaagcaaaucugagaaaccuaaacaaugaggccacaaaccugaggaucaaauaccuccuggaggaacuuaagaaugacacuuuuauuaaagauguccgcccauugagcccuaugcaccaggagaagaugcgaaucuaugaacaggcugugcugggcaacuuaaauaaacaggacaaggacuacgaugacauuaucaagauaucuaaaaaggagcggcccaccucagcggagcucauucguuauaaacuguggcuugaacaaaaguacugcaguccauacacaggaaaagcaaucagccuguccaaguuguucaccacugccuaucagaucgagcauguuauuccccagucuagauacuuugauaacucguucaauaacaaggugaucugugaaagcgaggucaauaaagaaaaggacaaaaugcucggcuaugaguuuauuaaggggaggggaggugaucgcauauacugcacggcucacggcaaagaggugacaauccugaaggaagaggaauauaagcaguucguaaacgagcauuacgcccacaauaaacggaagagagacaaccuacuggcagaaaauauuccugaguccuucucaaguaggcaacucaacgauacccgauauaucacuaaaaccauuaugucucugcuuagcaaugugguucgccagcagggggaggaagaggccacagcuaagaacuugcugccauccucaggagccgucaccgacaaauuaaagaacgauuggggccucaaggacguguggaauacuaucgugacaccgcgguuugaaagacugaacaaacuuagcgguacgaaugauuucggggagaugaaggaagagaacggcaauagguacuuucagaccaacguccccucugaguacgaaaaaggauucaagaaaaagcguauagaccaccgccaucacgcaauggacgcgcugguuaucgcuugcacuacacggaauauggugaacuauauuuccaaugugaacgccaauaguccuaaacaaagagaggaucuaaggcagcuccugugugacaagaaccgaaucauuaauaagccauggaacaccuuuacacaggaugcauugaaagcccugaaugacaucguagucagcuucaagaacaacgugcggauaauuaaucgcgcuacuaacagauaccaaagguaugauaaaaauggcaagaaaaugaucugcucucagaaggggaacgacaugugggccauccggaaguccaugcauaaagaaaccguuuuuggacgagugaauuuaauuagaaaggaggcacuccccauagcuaaagcccuggauaacaucucagcgauuuguaaugcccagcuucgcgcuuacgucaacgaccugguggauaagcacuucaauaaaaagcaguugguugcacauuuuaagagucucgacuauaaauggaacaggcaagaugugagcaagguagaggucuggaucucguccgacgauaaaacgccuaugguggccgugcguaagccacuggacaccucuuucgacaaaaagaagauugcuagcaucacagauacugguauacaggccauccuacugaauuaccuugaaucaaaaggcggggacgcacucgucgcguuugcccccgagggcauucaggaaaugaacaguaauaucgagcuguauaacaauggaaaggcucacaaaccgauuaagaacguucgguuguccgaaacccugggugccaaauaccaggugggggagagaggcgcaaagacaaagaaguacguaguggcugauaagggaacuaauuuauucuuugccaucuaugaggacgaagagggcaaaagguacuauuacucugucccucuccgcgaagcaauagagcgacaaaagcagaaacugagcccagugcccgaauauaacgagaaggggguugcccuuaaauucuaccuguccccuaacgauuugguguauguccccaccgaggaagagagaacgaugggaacaugccacauugacaagacccggaucuacaagauggugucaagcagugaaaauagguguugcuucguuccaucuacuaucgcuaaagugauugcggauaaggucgagcuccugucccauaacaaaaucgaaaaggccauaacaggcgagagcauuaaagagguauguuggaagcuaaagguggaccgccuggguaauauccuuaacguuauuaaauga

SEQ ID NO: 3408 - RNA, 4464 nt, Artificial Sequence
  Cas9 variant
augaagaacauccugggccucgaccuugggagcaauuccgugggaugggcccuggucaaaguugaggaaaacgguaaucccauuggcucuauaaagauggggucaagaaucauuccuaugagucaggauaucuugggaucauucgagaaaggcgacaccgugucccaaacagcucagaggacuuuauaccgggguaagcgccgacugauugaacgucacguacuaagaagggagcggcucugccgcgugcugcauaucaugaacuuucuuccagcacacuucgauagacuguuggggugggacaaaacggauaauaagaccuauggaaaguuuauagacgauucugaaccgaaacucgccuggaggcagaacaagaaugagaugggcaaaauggaguucgucuuuauggacucguuccaugaaaugcugucagauuuugcgaagcaccagccccaacugaucgcuaacggcaaaaaggugccucucgacuggacaauuuacuauuuacggaagaaagcccugacucagcuuaucagcaaggaggaauuggcauggauucugcuaaauuucaacaaaaagcgcggguacuaucagcuccgaggagaggaggaagaggaacagccaaccaaaaaggaggaauacaaaguucugaaggugaucagugucgaugccgacgagggucaaaagggcaaugggauaugguauaacauucaucuugaggauggaggcaucuacaaaaagaaauccgacauuccccuguacgacuggguggguaagacauugcagcucaucguaguuaccacuuaugaaaaagaugggaagacaccuaagaucuuugacucuggaaaacagaauccaagcuacagacugcccaaggaggaugacuggggcuuagugaaaaagaggaccgaaucccagcugcaaucaaguggcaaaacggucggggcuuucauuuaugauaacauacucagcaagccugacgauaagauccggggaaaucuugugcguacuauugagcgcaaauacuauaagaaagaacugaucgagauauugcagcagcaagcaaaguaccacgacgagcuacacaaccagaaccugcucgaaucuugugccaaagagcuguaugcucauaaugaugugcacuacaacgaagucauuaaguccaauaugaucaaccuucugguuaaugacaucaucuuuuaccagagaccauugaagucaaagaaaagccucauugccaacugcaaauaugagaguuacgaauauguggauaaggagaccggugagauuaaagaaaugccgauaaaguguaucgcgaaaucuaaucccuacuaucaggaguucaggcuguggcaauuuauucauaacuuacggcuguccgacguagugacacgagaagacgucacugcacaguaccuaagcaccccucaggauuauugcaaucucuucacauaccugaacgaccgcaaggagaucaagcaggauauccuuuugaaagacuucuuuaagauuaaaaaggugcaaauagauaaagagaagguuuucccaaucgaauggaauuacauuaaggacgccaccaaaucguaucccuguaacgagacgagauacgaacugcucucugcucugaagagggccggcauggauaaacaguggcuugacgauacuccuaauaugcaguaucggcuguggcacuugcucuacuccguggaggaaaaggaggagucagcaaaagcucugcgcaaguuauaugacgaugacaaguuugucacaaguuuccugaaaaucaagccauuuaacaaaugcuacggggccuauagcgaaaaggcgauuaaaagacuacucacccugaugaggaugggaaaggccuggaaugagcaggcaaucgaugcuaagacucuuaaauguauacaacagaucauuacagacaacguggacuccaaguugaaagaaaagaucgaugacucucguuacguacugcaccauguuagcgauuuccagggccuccccaccuaccuggccucauaugugauuuacggucggcacagugaggucacggacauccagugcugggauuccccggaagacuuacugaaauuuauacgagauuucaagcaacauagccuuagaaacccuauuguggagcaggucaucuuggagacccucagggugguuuaugacauuuggaaagcugaaaagcacaucgaugagauacauguggaaguagcccgcgagaugaagcugacagcacagcaacggaaugaagccaaccuaagaaaucugaacaaugaggcuacuaaccucaggaucaaauaccugcuugaggaauugaagaaugacaccuuuauuaaagauguccgcccccugucuccaauccaccaggagaagaugcgaauuuaugaacaggcgguguuagggaaccucaauaaacaggacaaggauuacgacgacaucauaaagauuagcaaaaaggagcacccuacaaacgcagagcugauccgguauaaacuuuggcuggaacaacguuacuguagucccuacacuggcaaggccaucagcuuguccaaacucuucaccacagcuuaugagauugaacauaucauuccacagucuagauacuuugauaauucguucaacaauaagguuauaugcgaggccgaagugaacaaggcaaaaggaaauaugcugggcuaugaguuuaucaagaaacagggcggacagaagauuuacuguacccaacuagguaaagccgucacuauccugaaggaggaggcuuauaagcaguucgugaacgaacacuacgcccauaacaaaaggaagcgcgacaaucuccuggcagaaaacauucccgagagcuucuccucacggcagcuuaaugauacgagauauaucacaaaaaccauaaugaguuugcugucuaacguagugaggcagcaaagcgaagaggaggcgacugcuaagaauuuacucccuuccucaggcagcguuaccgaccgacugaaaaacgauugggggcuuaaggacgucuggaauacaaucgugaccccacgcuuugaacggcugaacaagcuaucuggaacuaaugauuucggcgagaugaaagaagagaacgguaauagauacuuucagacaaacgugccgcucgaauacgagaagggguucaaaaagaaaaggauugaccaccgucaccaugccauggaugcacuggucaucgccugcacgacccgcaauaugguuaacuauauuuccaaugcuaacgccaacagucccaagcagcgggaggacuugagacaacuguuaugcgauaaaaauaggaucauaaacaagccuugggacacuuuuacacaggacgcacucaaggcucugaaugauauuguggugagcuucaaaaacaauguacgaaucaucaaccgggccaccaaucgcuaccagagauaugacaagaacggcaaaaagauuauauuuucucagaaaggagaugacaugugggcgaucaggaaguccaugcacaaggaaacagucuucggccgggugaaucuuauucgaaaagagguucugccaaucgccaaggcuuuggauaacauuucagcaaucuguaaugcccaacucagagcuuacgugaacgaccuggucgauaaacauuuuaauaagaaacagcuaguggcccacuucaagagucugaacuauaaguggaaucgccaggacguuagcaaaguggaaguauggauaucguccgauaacaagacucccauggucgcagugaggaaaccucuugacaccucuuuugauaagaaaaagaucgcgagcauuacggacaccgggauccagacaauucuccugaauuacuuggagucaaagggaggugaugccaguguggcuuucgccccagagggcauccaagaaaugaacuccaacauagagcuguauaauaacgggaaagcacauaagcccauuaaaaauguccguuuaucugaaccgcucggagcuaaguaccagguuggcgagcggggugccaaaacuaagaaauacguggaagcagacaaggggaccaaccuguuuuucgccaucuaugaggacgaggaaggcaagagauacuauuacagcguaccucuuagggaggcuaucgaacgccagaaacagaagcuguccccagugcccgaguauaaugaaaaaggagucgcguugaaguucuaccucucaccuaacgaucugguguauguucccacagaggaggaacgaacuauggggaccugccacauugacaaagccagaaucuacaagauggugagcaguacgggguguucuugcuacuuugucccauccacauucgcaaaggugauaguugauaaaguggagcuacaaagccugaauaagauggaaaaagcuauuaccgacgaguguaucaaggaagucugcuggaaacuuaagguagaucggcucggaaacauuaucaaugugauaaaguga

SEQ ID NO: 3409 - RNA, 4485 nt, Artificial Sequence
  Cas9 variant
augaagaacauccugggccucgaccuugggaccaauagcauuggaugggcccugauagauaacgagucccacagaaucauuaaaucugguucaaggaucauucccauggacgcugcaacaaugggcgauuacgaaaaggggaauuugaaaagugccgacuggaagcggacuagcuuccgcggaaugcgacguuuauaugagagagcgaaacugaggcgggaacgccuacucagagugcugaacauccuuggcuuucugccugaggaguucaggcggcagauagauuuugaacaucacccaggucaauucaucgacgggaaggagccguugauugcuuaccaucacgaugaaaauggacagcgcgucuuuuccuauaugucugccuucgaggaaaugcucacggacuuucgagcaacccagucggagcugguuagagauggcaggcgggugcccuacgacuggacaaucuauuaccugcgucauaaggcccucacucagccuguaaccaaagaggaauuagcuuggauuauccugaacuucaauacaaagcgcggcuauuaccaacuuagaucagagagcgaagaggugaccacuaacaaaaaugaagaguacgcagaguugaaggucgugaguguugaaaagacaggggaggauaagaagagggccggauauuacugguauaccauaacguacgacaacgaagcugagcagaaaauuacuuccaccaucccaccccggcagauuggugauaagguggaacugaucgucacaacugcccgagacaaagcgggcgagaucaagaaaucugugcgcagcccuaaggaggacgauuggacccuaaugaaaaagagaacagaacacaauauugaggaagaggaaugcaccguaggguccuauauauaccagcacauccucgcagacccaacgguuaaggugaggggaaaacugguccauacuauugagcggaaguuuuauaaaaaggagcuuaaacaaauccugaacaagcagaaggaguucauacccgaauugcaggaugccucacucuacgaggcuuguauuaaagaacuguaccgcaauaacgaggcccacauccagaguaucgcaaauaaggacuuuacagauuuauucgugaacgacauuaucuuuuaucaaagaccucugaaaagcaagaaaucuaccauuuccaacugcccauacgaaucauauuacuauaagaauaaggagacuggcgaacucauaaggaaaccgaucaaguguauugcuaaaagcaacccccuuuaccaggaguuccgucuguggcaguucgugcauaauuugcggaucuauaagaaaagugaagaggucucuggucgacuacaaacagauguugacgugaccgauagauuucugacgaccccugacgauuacgccaaacucuucuccuggcugaacgacaggaaggagaucaaacagaaggaacuucugcgcuacgaggcguuuggguugagcaaaucguauggagacuaccgguggaauuucguagaagauaagccauaucccugcaacgagacacuccacgaaauuaauagaaggaugaaaucuauacuguccgacaagaaauuaucaagugaggccuaccagcagcuguggcacauccuauauagcauugaugacccuaucgagauucgcaaggcacucacuuccuuugcucaaaaccaggaaaucaauucugaugacuucgugaacgccuuuuaccaguaugucccagagaagaccaaaagcuacggcgcuuacucagaaaaggccauaaagaagcugcuucccuugaugcgacggggcaguuauugggcaaucgggaauauugaugagaaaacacaucguagacuggacaacaucauuaauggaguggccgaugacuccaucagcacuuguaccagggaaaagcucaacaaucugacagauauaaccaugugccaggguaugccgcuuuggcaggcuuguuacgcgguuuaugaccgccacucugaggcagccgauacuacgaagugggagcaaccugacgacauugauacauaccugucaaccgaauugaaacagcauagucuccggaaccccaucguggagacugucauuagcgaaacccugagagugguaagggacaucuggaaggcuuauggccgaccagaggagauacacguugaauuagggcgcaaccugaaacaggaugccaagucccggaaacaagacgcaaucagaauggccgagaaugaacagacaaaccuaaggauucgugcucuccugcaggagcuuucuaauccugaaugcggaguggagaacguccgcccccauucgccaagccagauggaguugcugaagaucuacgaaaaugaggugcuccaauccaccgaugacauucccgaagagaucucaaacauaauuaaggaucugggcaaaacugacaguaagaaacggccuucuuuaagcgauaucacaaaguauagacuguggcuugaacagaaauaccaguccccauacacgggucacaucauuccguugucaaaacucuucacccccgccuaucaaaucgagcacgucauuccucagagcagguacuuugacgauucuauauccaauaaggugaucugugaggcagaaguuaacaaagagaaggaccgaaugcugggguaugaguucauuaucaauaaaggcggaaguauugugaagggcagcuuugggcagcaguucaaaaucuuugauaagguacaauacgaagacuucgucaaacagcgguaugcgcauaacaagacuaagaugaaaaagcuacugauggacgauauaccagacggauucauccagcgccagcucaaugauucuagauacauguccaaaaagauuaucucaauucugaguaacaucgugagggaagacggugagaaagaggcuacaagcaagcacauaauuguuaccucgggcgccaucacagaucggcuuaagaaagaaugggggaucaaggacguguggaaugauauuauagcaccccgauuuaaaagauugaacaagcugacugacuccaauaacuauggaauggagaccgaaaaagagggccgccaauacuuccagaucaacgucccuacggaguuaucuaccggucucauuaagaagaggaucgaucaucgucaccacgccauggacgcuauuaucauagccugcacaacucggaaucaugugaacuuucugaauaacagcaccgcagcuucagaucagaaagacaucagaagggaccuucagcacacacuguguacuaagaccaaaacggauaguaaugggaacuacguauggcgcuucaauaagccaugggacacauuuacccaagauacucgacaggaauuggagggcauuaucguguccuucaaacagaaccucagaauuaucaauaagaugucuaacuauuaccaacauuauguugacggacggaagacaauaagcaggcagaauaaaggcgaugggugggccauucgcaagucccugcacaaagcgaccgucucaggaaaggugaaccuaaaacguagcaagacuguggguuuuaaggaagcccugaaugacuggagugcuaucaaagauaagaccucuaaagcaauccuccagaagauuaucgcccaguacaaaaacuaugaccccaagacaauauucaaauacuuuaaggauagaaauuucaaggucgagggcaaagacuuuuccaagcuggaaguuuauuacaacacgagcgauaaagagccgaugucggcucaucgggugaacauugacaccacuuucgaugagaaggaaaucaggucaauuacagacaccgggauccagaaaauaaugcuuaagcacuugcacacauacgacgaugcccaaggaaagacucauccugaggcagcguuuucuccagaaggcauugagaaaaugaaucagaacauccgcaugcugaauggugggaaggaccacaaacccaucuucaaggugcgaaaagccgaaauuuuaggcaugaaguucgcuguaggagagagaggccauaaggauaaaaagugggucgaggccgacaaagggaccaaccucuuuuucgcaaucuaugaaagugaggaaaauaagcgguccuacagcucuauuccucugaacgaggcuauagauaggcuuaaacgcggagaaaauaucgccgacgagagagaucagaacggcaauaagcugcuauuugugcucagccccauggaccugguuuaugugccagauccugacgaugcacacauugacgaggucaaggguaacaauaacaucuucaaaaugguguccugcacggggacagaaugcuacuuuguucccgagaccuaugccaaugugaucuguaagggaaaagaauuggagucaaagaacaaaguagagaguuacgauggcauuaauauaaagaaaagcugcuauaagaucacugucgacaggcuggguaaggugcggaaaauuuucaagggcuga

SEQ ID NO: 3410 - RNA, 4491 nt, Artificial Sequence
  Cas9 variant
augaagaccauccugggccucgaccuugggacaaacagcauuggaugggccaaagugugcgucgaugacaaugguaacuaccugagagauauaaaguugggcuccaggaucauucccaugucucaggacguuuuagggaauuucgauaaaggagugacugagucacaaacgaguguacggaccggcuuucgcggugugcgacguaucagagaaaggagccugcuacggcgcgagagacuccacaggguccugcaugugcuuggguaucugccuccacacuacgacuccgcuauuggauggaacaagaaugaaccgucuacauauggcaaauucuugaaccauggcgagcccaagcucgcaugggaacacaaggaggaugggucgaugcgguuucuguucauggagucauuucaugaaaugauggccgacuucgcgaaaagccagccuagucugguuuccgauggaaagaaaaucccacucgacuggacuauauacuauuuacgcaagaaagcucugucucagcccauccgaaaggaggaacuugccugguugcugcuaaauuuuaaccagaagagagguuacuaucaacucaggggcgaggaggaugacgauaauccuaccaaaugugaagaguacuacgaacugaagguggucgggauugaggcagacgaagagggaaagaacggcaauacaugguauaacgugaaacuugagaaugguuggaucuaccggcgucagagcaaaauuccacuggacgauuggaucgggaagguacgcgaguucauaguuaccacugaauaugaaaaagacggaauuacauugaagaaggauaaaaacggcgacgugaagagauccuuuaggucacccagugaggaugacuggggccuccggaaaaagcgaaccgaaaaacuguuagauagcucuaagaugacggucggggccuucguguacgaccaucugcucgcugagccuuccgauaagauccgcggaaaauuuauuagaacuaucgagaggaaguauuacaaaaaggaacuuuaugcaauccugugcgagcagucaaaauaccacgaagaguugcggagcggugacuaccuaaauaagugugccgaggaacuguauaagaacaaccagccacaccgcaauagucuccugaccaaagaucuugcuuaccuguugcucgaggaccugauuuucuaucaaagaccguuaaagacuaaaaagucucugauagccgaaugccccuacgaggcguauaaauacguggacaaggaaacaggcgagaucaagaggcaggggauuaaauguaucgcaaaguccaacccuuauuaccaggaguuucgucuauggcaguucauaagcaaucuccggcuguucaacaaagccgaugacaaggaagucaccgcugauuaccuuccaacacaagacgauuauguucgauuguuugccuaccugaaugacagaaaagagauuaaccaggaaacccuccugaaggaguucuuuaaacuuaagaagaucacgguaaauucggaaaaaguguuccccaucagguggaacuauauugaggauaaggagaaaaaguacccuugcaaugaaacucgccacgagcuguugcucgcacuggaccgggcuagaaucgaucauucuugguuagaaaaaccaggacaggaguauaggcuguggcaccuacucuacuccguggaaucaaaggaggagacaaaggaagcccugcgcaaacuuaaggacgaugacgcguuugucgagaguuucuugaaagugaagcccuuuaaacgagaauauggcgccuacagcgagaaggcaauuaagaaacugcucgcuguuaugcggauggguucccuguggcgugaaaccgauauaugugacacuacaaaggggaacaucaccaaaauuuuacaaggcgagaucgacgagaagcugaaagaaaagaucucugccagcgugucaaguuacaaucagcuuuccgauuuccagggauugccggucuggcucgcuugcuaugugguauacggcagacacagcgaggccgcagaaauucagcauuggaagacgccugagucucugcuagccuauauaaacggguuuaaacaacacucacugaggaaucccaucguugagcaguguauucucgaaacccugcgcacagugcaugacaucuggaaggaggucggacacauugaugaaauccauguggagcuuggucggaacaugaaaaguacugcugaccagagagcgaggauaagcgaaaaugucuugcgaaacgagaacaccaaucugcgcaucaaguccuuacuccuggagcuuaaaaacgauccaaauauuaaggacgugcggccuuacucucccaugcagcaagaaaaacugagaaucuaugaggaaggcguuuugcaggagcucacaaaggaugacaaggauuucacugaaauuaccaaaaucucgacaauggcacagccaagcgccaaggagcugcagagguacaaacuauggcuggagcaaaaguaucguucccccuacaccgggaaaucaauaagucucacuaagcuguuuacgucugcuuaccagauugaacacgugaucccucagagccgcuauuucgacgauuccuuuucaaacaagguaauuugcgagagcgaagucaauucucuuaaagacaacauguugggauacgaguucaucaagaaucacggcggugaaauaauccauuguacaaugcugggggaugugaaaguuuuauccgagagugaguauaaggccuucgugaacgaccacuacgcacauaauaaacggaagagagaaaaccuccugcuugaggacauuccacaggaauuucugaauaggcaaaugaacgauagccgauauaucucuaaggucgugaaagcccuacucuccaauauuguacgggcugagggcgaggaagaggccaccucaaaguucgugguuaguugcagcggaggcaucacugaccgccugaaaaaggauuggggguugaacgacgucuggaauaaaauaguguacccgagauuugaaaggcugaaccgguuaaccggaacagaggcauucggucagugggaaaacaaggauggcaagcgaguguuucagaccgcggucccccucgagcugcaaagaggguucaauaaaaagcgcauugaccacaggcaccaugcuauggaugcccuuguuaucgcaugcacuucgcguaacaucauuaauuaucugaacaaugaguccgccaacaauccuaaaaagcgggaagacuugagacagaaacucugugauaagaacaggacaauccgcaagccaugggagacguuuacccaggacgcuacugccgcacuggaagaugugauugugucuuucaaaaauuacguacgaauaaucaacaaggcuacaaauuacuaugagagauacgacgucgaaggcaaaaaggugauugccgagcagcggggagacgauaugugggcgaucaggaaacccaugcacgaggccaccuauuacggucgcguuaaccuacguagaaagaaaaaggugaaucugcgggucgcucuugaaaacauuagcucaaucugcgacaauaagcucaggauauauaucaacgggcugguggagaaaggcuuuaacacaaagcaaauuuuggauaaauucaagaauacuaacgaccauuuuaguaugcagaaaaucgauaagguugaaauuuggcaguucaccaaugaggaagagaagcugguggcaacgcgcaaaccuuuagacaccuccuuugauacaaagaaaaucgccucuauaacugacaccggcauucagacaauccuccugaacuaccuugagacuaagggaggggauagcaccaucgcuuucacgccagaaggaauuguagagaugaaucaaaacauauccaaauauaauaacggcaaggaacacaugcccauccugaagguccgauuguacacaaaacucgguaagaaaauuccgguggggcagaccggauguaaggccaaacaguucgugaucgcagaggcgggcacuaaucuguacuuugccauuuaugaggacgaagaggguaagagaucauaccggacaaucccucuaaacgaagucguugagaggcugaagcagggccuuagcccagugcccgagaaaaaugauaaggacguacaucucaaauucuaucugaguccuaacgauuugguguacguccccauagaagacgagcacgaaucuuuagcuaaggaccacaucuauaaauuuguggauuccagcgggaccacugccaauuucauuccacaucgcucggcaaacguuaucuuugagcugaauaagaaagacgcugaaaaguucugcucaggaucuauuauccaaaacgaguacggcguggggaguucccagagcaagaaucagaaagccauaaccggagaaaugauuaaggcagucuguagaaaacucgagguggauaggcugggcaacguuaucaaggugaucuga

SEQ ID NO: 3411 - RNA, 4497 nt, Artificial Sequence
  Cas9 variant
augaagcacauccugggccucgaccuugggaccaacagcauuggaugggccgugauaagagcucaucaggaugcagacggucacacaacucugcaagauaucuuggccgcgggcuccaggauuauccccauggacgcugccacguuaaccgauuucgacaaagggaaugcacggucuggaacagccgagcgcacuucauuucgaaguaugcguagaaggcgggaacgccagcugcuaagaagggagcggcuccaucgcguccugaugcuucugggcuucuugccucagcacuacgcuaacagccucacccgauauggugaauuugcagauaauagagagugcaagcugccauggguuaaagacgaauccgaugggaaguaccauuuccuguuucaggacgccuuccacgagaugugugaggauuuuaggcaacucgcuccgcaguggguggccgacggaaagaagguacccuaugauuggacauuauacuaucugcggugcaaggcgcuuucucguaaaauuucgaaggaagaguuggcauggauccugcuaucauucaaccagaaacgcggcuacuaucaggccagagacgaagaggacgaggugaccacuaauaagcucgaagaguacuacgcuggcaaagucgugaggguugaugacacaggggaacggaagggaaagaacguguauuacgauauaacccuggagaaugguugggucuaucgauacgccgcacgcaucuauccugacugggugggccaaguaaaagaauuuauuguuacgacuacccuuaacccagaugggacacccaagacugacaaagcuggagaggugaagagaucauucaggaugccuaaagaugacgauuggacccugaucaagaaaaagaaggagcgggacauugaucgcagucaggaaacaaucggccaguacauauaucacgccuugcucaaagacccaucccagaagauuagagguaaacugaucgggaccgucgagaggaaguacuacaaagacgaauuacgucggauucuggaucgacaaauccaguuucaucccgagcucagagacagggaacuuuauuacgcgugucugcaggaguuguauccuucuaauguggccuuccgcaacacgcuagugaaucgggauuuuacuuaccuguuccucgacgauauccuguucuaucaaagaccacuuaagagcaagaaaucccagauuucagacugcccguacgaggaacacuuuuauacagauaaggagaccggagaaaggauaaguguccccguuaaauguaucgcagugagccauccucuguaccaggaguaccgcuuguggcaguucauucaaaaccuccgaaucuauugccgggaagcucguauagacggcaaucugaugauugauugggagguaacuaacgaguuacugcagacagaagaggacaagaccgcccuauuugauuggcucaaugacaaagaaucugugaagcagccagagcuggucgcuuuccuuuugggcgggaaggccaacaaaaagcagaucaaagcauacagauggaacuauauggaugacgacacgaagggauaccccuguaaugagaccagggccucccugcucaaauaucugcgcgaagcucaaacagauagcagcuuucuuacucgggagagagaagaggcgcuguggcacaucuuguacaguauuucugacaagggugaacucaaguccgcacugggcaaauucgccgugaagcacggguuaaacgagagguuuguuaccguguucagcaaauuuccuccauucaagaaagauuauggaucguacucugcuaaggcccugaaaaagcuacucccccugaugcgaaugggccaucacuggcaggaggcauccuuuaucccgucaacacgccagcggauggaaaaguucauuaauggugaguacgacgauaguauagacaaaagaacuuaugaaaaacuugagagcuugaccgaagucucccaguacagggggcugccuggcuggcucgccugcuaugugguauacgaucgucauucugagggacgcgacaucgagcgguggacaagccccucagauauugacaguuaucuggcucaauuuaaacagcacuccuuacauaacccaaucguugaaagagugguccuggagacccuuaggacugugcgagauaucuggaagcaggucgaccacauugaugaaauacacaucgaguugggccggaauaugaaacucccugccgacaagcgcagacagaugacggaacaagcauggaagaacgagcagacaaaucugaggauuaaagcgcuacugcucgaguucgcucggcccggguacgacaucgaaaacgugcgaccauauagccccuaccagcaagaucagcugagaauuuacgaggaagccguucuuggagcaaaugaguguccugacgauaucucugccauauugaagaaauucaacggucugaauccaccgaccucagcugagguguuacgcuauaagugcuggcucgaacagaaauacaggagucccuauacuggccguaccaucccucugagcaaacuuuuuacauccgccuacgagauugaacauaucauuccaaagcagcgguauuucgacgauucuuuuucgaacaaaguaaucugugagagcgaagucaauaagaaaaagggggcaaugcugggauacgaguucauaaaauccuaucacggcgcuucaauuaccuugaacagaggugggacugccaguaucuuuucuguggaggcguacgaaaauuucguuaaggagcauuacgcccacaacaggggcaagaugaaaaagcuccugauggacgaugugcccgacagcuuuauuucccgccaacuaaacgauucacgauauaucagcaaacugaugaagucuauacucuccaaucuggucagagaagagggagaaaaagaggcuaucaguaagaaccuuauugugugcacaggcgggaucacggaccgguugaaaaaggauugggguauucacgacguauggaaugacaucauauucccuagguuuaagcgccuggaugagauggacagcucucauaccuacauuacuuuaaacacacaccgucauccaauccccuccaugccgcucgaguuccagagaggauuuaguaaaaagcggaucgaucacaggcaucacgcaauggacgccauugugaucgcuugcgccacccgcaauauuguuaacuaucugaauaacgaaucagcacgacacgaugcgaaaacaagcagaauggaccuucagcggcugcuauguacugccaauaggaagcucauagauaaaccuuggaagaccuucacgcaggauaccugcaagguccuggaagacaugaucgugucguuucaacgcacauugagaauuaucaacaaaacuaagaauuacuaucugagguucgaggacggcaaaaagcggcguguguuacagaccaaaggggauaacugggcuauucgcaagccacuccauaaggaaacauucuacggagagaucaaucugcgaagaauagagacucuuucccugaacaaagccuuggaaaggauccccgacauugucgagcgggaucuccgcaagaaacugucugaacuacugagccuuggcuauaaugcaaagagaaucaaagguuacuuugaggagcacaaggaagaguggucagacguuaaccucaguaagauuaaggcuuacuauuucaccaagcagaaaaacaagagguacuuugccgcacggacggaacuggacacauccuucaauaaagauaagaucgagaacaagauagccgacaccgcuauucagaaaaucuugcugcaacauuuagaagcguaugggaaugauguggagcaggccuuuucuccugagggcaucgacacuaugaaccgaaauauuagacagcucaacggaggccgcagccaccaacccauauacaaggugaggguauaugaagaggcaacaaaauucgcugucgggcggcguggaaauaaguccaccaaauuuguggaagccgccaagggcacuaaccuguucuuugcuaucuacgagauuucacagguugaugguaaugggaacagacagaccagcaggacauucaguucuaucccacuuaauguggcagucgaacgccugaaacagggauugccucccgugccagaggacgaggaaggcaacgccccgaaguauguucucuccccuaaugaucugguguaccuacccacggagaaggaacugaaacggcgagagauugcgaugccaaucgacaagagcagaauauacaaaaugguaucguguaccgguaaggauugcuuuuucauccccgcuaacacugccgucccuauuguggacagguaugaauacucaucuaugaauaaaaucggccgcgcacuuacaggggagaugauuaaggagaucugucucccacugaagauagaucgguugggacaaauuaucgaaaucaguaccuucuga

SEQ ID NO: 3412 - RNA, 4506 nt, Artificial Sequence
  Cas9 variant
augaagaaaauccugggccucgaccuugggaccaacagcauuggaugggccgugauaaauaaggcugagaacgaagguaaagauguccugugcggcaucgaggcagccggguccagaauuauccccauggacgcgacaauuaugggagauuucgaaaagggcaauucuguuucacagacuaaagacaggcgggagcaccgcaguacgcgacguuuguacgaaagagguaaguuaaggcgggagcgccugaacagagugcuaagcguaaugggguuucucccugaucauuaugugucccaacuggacagguacggaaaguuccuuucuaauaccgagccaaaacuggcuuggguccggaacgccgauuguaaguaucacuuuuuguucauggacucguuuucagaaaugcuccaggaguucaaaacaaauagcccgcaguacaucagugaagaguccaaggugcccuaugauuggacucuguacuaucugcgcaaaaaggcacucacccauaagguuacaaaagaggaauuagccuggauacugcuuaacuuuaaucagaagcgaggcuacuuccaauugagagacgagucugaagaggagaaaaagccuagcaaaaucaggcaguacuuugaacaccagaagguggucgauauuaucgacaccaacgagguguauaaaggccugaagguacuaauuguuauccucgcuaaugggauauccggaaagauuuucaaaaaggaaaucccagauuggauugguguggagaaagacaucaucgucaagguggacauugauaaagacggcaaggauaaguuuaacgaagacgggucacugaguugccgguucaauauacccacugaggcagaaugggauacagagugggagcuuaucaaacagaagacccaaaacgaccuggaugccagcggaaaaacggugggcgaauacauuuuugacacuuugcuccguaauccugagcagaagauccgcgguaaacuggucagaaccauagaaaggcgguauuacaaggaggaaauuaacgcuaucuuaaagaaacagaaggaguuccauccagagcugucugaucgagcccucuaugaaaaauguguugaggaacuuuaccccaacaauccugcgcaccgcaacaugaugcugauccacgacuuguccuauuuccuagugaaugauauucuguuuuaccagagaccacucaagagcaaaaagucacugaucgacgagugcccguacgagagucaucuuuauauugacaagaaaucuggggaaaggaagcccguagcagugaaauguauagccaagucccacccucuguaccaagaguuccgguuguggcaguuuaucagcaaccuccgcauuuaucagaaaacaaaggaagucggaaauucgcugaaaguggauguugacgugacuaacgaguucuuaaagggcgaaaaugauuacgucgagcuguuugacuggcuaaacaccaagaaagagaucaagcaagaagauuuccucaaauauaagccauuuggcuucacaaaagggaauaucaacaauuacagauggaacuauguggaggacaagauuuaccccugcaauaagacccauuacacgauacugaaaggacuugaaaaggcugauaucacuuuugacgaguucauuucucacgauuccuuggccgaagagaaccuguggcacauccucuauucaguaaguagcaaagaggaacugaagcaugcacuugaguccuuugcugacaaaaggggucugucuauuaaguucguugaugccuuuaucaauaccccugcguucgaaaagagcuacggcgccuauucagcaaaagcuauaaagaaauugcucccacugaugcguauggggaaguacuggaaagaggaaaacaucugugacaguacacgggagcgaauugauaagaucauuacuggagaguaugacgaaaacaucagagacagggugcgcgagaaguccauaaauuuaacagauauuacccuguuccggggccuaccccucuggcuggccugcuacgucguguaugacagacacagcgaagcugguaacacggagagguggaccucuccgucagauaucgaccauuacauucgcaaauuuaagcagcacagucuucgaaauccuaucgucgagcagauaguguuggaaacacugcggacuguucgugauguguggaccgagguagggggcaucgacgaaauucaugucgagcucggaagagaaaugaaaaaccccagcgauaagaggcgcaaaaugucccugcagaugcaagagaaugagaacacaaauuuacggaucaaggcccugcuugcagaauuuauuaacccagaguugggcaucgaaaaugugagaccuuacucucccucgcagcaggaccuccugaggcuauaugaggaaggggccuggaacagcccagagauagaugagaaacagguugacgaaaugcuggcuauucucaagaaguuuaaugagacugauuccucaaaacgacccaccaagagugaaaucaaacgcuaccggcuguggcuugagcaaaaguauagaucuccuuacacaggaaccccaaucccguugagcaaacuguucacuacggcguaugaaauugagcacgugauccccaggucccguuucuucgacgauucauuaacaaacaaggucauuugugagagcgaagugaauaagcucaaagguaacaugcugggcuacgaguuuauaaagucucacuauggggaaaaaguacagcuuuccaguggaagcgaggugcagaucuucucuguuaaugacuacgagaaguuugucaaagaccauuacuccaagaacaaggcaaaaaugaagaaacuguugauggaugacauuccugaaaaguucaccgagcgccagaugaacgauucacgguauaucaguagacucauugugagccugcuaucgaauaucgugagggaaaaaggcgagcaagaauccauaucuaagaacguccugguuugcacugguggggugaccgaccgacucaagaaugauuggggcgugaacgacguauggaauaaaaucauucugccacgguuuaagcgcaugaacgagaucacagauagcaccgacuacacuucagucaauacaaguggacacauuauccccgccaugccucuucauuugcagaaaggcuucaacaagaaaagaauagaucacaggcaccaugcuauggacgccauugugaucgcaugugccgggcggaauaucguuaacuaucugaauaaccaguccucuaagagcgaugugucccgacacgacuuaagaaaucuccugugcgagaaggacaaaucagaucgcaaggaacuuauuauaaaaccaugggacacguuuacccaggaugucuacagcgugcugaguucuaucauuguuuccaucaagcaaaaccuaagggugauuaauaaaacuaagaacaucuaucagcguaaagaggacggaaagguaauaaucagcaagcaggaaaacaauauuaacuggugggcuauccggaaaccccuccauaaggagacagucucgggugaagugaaucugagaaaagagaccacaauuucauugaaggaggccaucgauaacccggcaaggauaauugacaaagauuucaagaagaaacugcgcgaauuaauccucaugggcuacaaugagaagcugaucaaaaaguauuucuacgacaacaaugaaucuuggcaagaugugaaccuuaaaaagauuccugcguacuauuuuacuaaggacaccaaugaucgauacuucgcuaguagaucccuguuggacgagaacuuugauaaaaagaaaaucgaaaauaaggucacggacaccgggauacggacaauucuccugaggcaccuagagguugagggaggcgacagcaaaguggccuucucuccagaaggucuggagcgcaugaacaagaauaucgaaauucuuaacgggggcaagaaacauaagcccaucuauaaaguacgugaguacgagaaggcagaaaaauuugccgugggaaugagaggcaauaaggcuagcaaauucgucgaggccgcaaaggggacuaaccucuuuuucgcuguguaugauaauggaaagaaacgguccuuugccaccguuccucugaacgaagugauaagguugcagaaggagggccugcccucagcgccagccaacgaagaggguuuacucccuaaauucguccugagucccaaugaccuuguguacguuccaacagaggaugaacugcgcagcggguugcucccggagaacccugcucccgaacgaauuuauaagauggugucuugcacuggauaccagugcuuuuucauccacuucuccgucucaggcguacugugugacaaaaaggaguuuaguagccuaaauaagauggaaagagcaaucuccggugagaugauuaaagagaucuguauuccacugaaggugaaccggcuuggcaaaauaauguacaaucucuga

SEQ ID NO: 3413 - RNA, 4506 nt, Artificial Sequence
  Cas9 variant
augaagaccauccugggccucgaccuugggacaaacagcauuggaugggccaaaauauccaucgaugacaaugguaacuaccugagagauauucaguugggcucuaggaucauucccaugucacaagacguguuagggaaguucgauaauggagucacugagagucagacggcuguucggaccggcuuucgcggucugcgacguaucagagaaaggagccuacuccggcgcgagagacugcacagggugcuucauguaaugggguuccugccuccacacuaugacuccgcaauaggauggaacaaagaagaaccgucuacauacggcaaguuuuugaaucauggcgaacccaaacucgccugggagcggcagggggauggaucgaugcgcuuccuguuuauggacucauuccacaagaugauggaggauuuugcgccucaucagccagcucugguggccgacggucgaaagaucccccucgauuggacuuuauauuaccugagaaagaaggcacuuacccaaccuauuaaaaaggaagaguuggccuggauccugcuaaacuucaaucagaaaaggggcuauuaccagcuccgaggggaagaggaggaagagaacccaacaaagcgugaagaguaucacgaacugaaggucgugagcguugaggcugcagaggaaggaaaaggcgguaauaccugguacaacgugaaacuugagaauggguggauuuaccaccgccccaguaaaaucgaccuguccgauugggucggaaagacuaaacaguuuauagugacaauggaauaugaggccgacggcauuaccuugaagaaaaacaaggaaggcgagguaaagagaucuuucaggguuccugacgaggaugacugggggcuccggaaaaagcgaacggaaagccaacuggaggcuuccggaaaaacugugggugccuuuaucuacgaucauuuacuggcggaaccagcagacaagauucgcggcaauuucaucagaaccaucgagaggaaauauuacaagcaggaacucgccgauauucuucgggagcagucaaaguaucacgaggaacugcagaguaaaaagauauuggcugacugcgccgaggaacuauaccgcagcaaccaaccgcauagagauucucugcucaaaaaggacauggucuaucugcuucugacagauuugaucuuuuaccagaggccccucaaauccaagaagucacugauugcaaauuguccuuacgaguauuacgaguauguggacaaagaaacuggggagaucaagcgucagggaauaaaaugcguggcuaagagcaacccauacuaucaagaguuccgguuauggcaguucguccugaaccuacgacucuacgauagaaccgaggacaaagaaguuacagccgaguaucugcccaguaaggaggacuacgcgaggcuuuuuguguacuugaaugaucgcaaggaaauuaaccaggagacccugcucaaagacuucuuuaagcugaaaaagguaaaacagcggucugaaaaggaguucccugugagauggaauuauaucgaagauaaagagaagaaguacccauguaacgagacgaggcacgaacuucugauggccuuggaccgcgcaggcauggagcgauccuggcucgaugacacugcucggcaauaucgucuguggcacuuacuguacagcaucgaagucaaagaugaggccgaaagagcucuaaggaagcucaaagacgaugacgaguuugugucggccuuccugaagguuaaacccuuuaagaaggauuauggugcauacucugagaaagccgugaagaaacuuuuggcugucaugcgcauggggucccauuggugcgaagacgauauuuguaaggagacaaaagaacggaucgagcacauucugcagggcgacguggaggaaaagauaaaggagagaaugaaucauaccgcguauucacucggagaacugagugacuuccagggcuuaccggaguggcuggcaugcuacguaguuuacgggaggcacagcgaagccacugauaucaaacauuggaagacaccugagucccuuauggcuuauauuaacggauuuaaacagcacucuuugcgaaaucccaucguggagcaauguauccucgaaacccugcgcacgguccacgacauuuggaaggaggccggucauauagaugaaauccacguggagcuaggccggagcaugaaaucaaccagugaccagagagcaaggaugacagaaaacauucugcguaaugagaacacuaaucuccgcaucaagucccugcuuauggaguugaagaacgaugccgacauuaaagauguccggccauacagcccuaugcagcaggaaauccugagaauauaugaggaaggggcuuuacaagagcucaccaaggaagacaaugauuacgaggagaucuucaaaauuucuaagaucccccagccaucagccaaagaacugcuuaaguauaaacugugguuggagcagaaguacaggagucccuauacaggaaagccuauuagccucuccaaacuguuuacuucugcauaccagaucgaacauauaauuccacaaucgcgauacuucgacgauagcuuuaacaauaaggugaucugcgaguccgagguuaacgcgcuaaaaucaaacaugcugggcuaugaguucauuaagaaucacgguggggaaaucgugcacuguacccuccugggcgacguaaaaguccagaacgaaagugaguacaaggcuuucgugacagaacauuaugccaauaacaaguacaaaaaggagaaacuuuugauggaggauauaccgcaggacuuucugaaucggcacuuaaacgacucucgcuauaucagcaagguugugaaaacccuccuguccaauauugucagaacugaagaugagauggaaacgacaucaaaguucgugguaagcugcaccggaggcaucacugacaggcuuaagaaagauugggggcugaacgacguguggaacucuauuguuuacucccgguuugagcgacuaaaugaacucaccaagagugaugcauucggaagaugggagaauaaagaggguaagcgcgucuuucaaacaagcgugccccuggaauugcagaggggcuucaacaaaaagcguaucgaccaucggcaccaugccauggaugcucuggugauagccugugcaucuagaaauauuaucaacuauuuaaauaacgaguccgcuaacucaccuaagaaaagggaagaccuccgccagcagcugugcgauaagaaucgaaucauuagaaaaccaugggagaguuuuacccaagacgcccgggcggcccuugaagaugucguugugagcuucaagaacuacgugaggguaaucaauaaaacuacaaacuacuaugagcgcuacggggcugacggagagaagacgauugcaaagcagaaaaauucggaaaugugggccguccguaagcccaugcacgaggcuaaauauuacggcagagugaaccugcagcggaagaccgaaguuagguugaaagccgcacucgaggacauaccuuccaucugcaauaaggagcugcgcgauuauauuaaccggcuagugaaaucuggucugaaugcgagacagcuucucgcccacuuuaagagcacugacuacuguuggaacaagcaaaaugucgauaaaguggaaguuuggcgguucucagacgagaaggaaccacugguggcuaucagggagaguuuggauacauccuuugacgccaaacgcauugauaccaucacagacacugggauacagaagauccuguuaaacuaucucgaagcaaaaggcggagaucccgcuauugccuucaccccggagggcaucgcagagaugaaucagaacauggcccuguacaauaacgggaagaugcaucagccuauucuuagaguaaggcugucuaagaaacggggaaagaaauaccaagucggccagacggguugcaaggcuaaacaguuugugaucagcgaauccgggaccaacuuguauuucgcgauauacgaggacgaagaucguaaucgcacauauaacacuauuccacucaaugagguggccgaacgacugaagcaaggacuaucacccgucccugagaagaacgagaaagaaguuccccugaaguucuaccuuagcccaaaugaccucguguauguaccuaccgaggaagagauccugaugaaagaauguaaguugaacaaaaauagaaucuacaaguuuauugauaguucuggcacaacugcaaacuucgugccccacagguccgcuagcuuaauauauaaugucgacaagaaacuggccgaggccuuuugcaacgacgagaucauucagaaugaauacggugugggcucgccacagucaaagaaccagaaagcucucaccggggagaugaucaaggcaguuuguuggaaacuggaaguggaucggcuuggaaauauuauccgcgucauaaaguga

SEQ ID NO: 3414 - RNA, 4515 nt, Artificial Sequence
  Cas9 variant
augaagaacaucgugggccuggaccucgggaccaauagcauuggaugggccgucguuaacgguaauauaaacgaugacggcuccgagcagcuugugaaaauccaggcuucugggucaagaauuauccccauggaugcagccaugauuggagacuucaauaagggcaacaguaucagccaaacagcggaaaggacucggcugcgcgguauacgacguuuguccgagagauacuuacugaggcgggaacgccuacacagaauccucgauauucugggguuucuuccuucucauuucgcuagggaccuggaucgguauggaaaaaucguaaaggacaaagagccaaaguuggccuggcgcaagaaugaagcaggccaguuugaguucauuuuucagaacucguucaaagagaugcucgaagauuuuaagcugaaucacccgaaccugaucacggacgauaaaaaggugcccuacgacuggaccauauauuaccuccgaaagaagggcuuaacaucaaagauuagcaaagaggaacuggccuggauccuuuugaauuucaaccaaaagagaggguauuaccagcugaggggagaggaggaagaggaaaauaaaaacaagcaggucgaguuuuaugcucuaaaagugauugcaguugaagauaguggugagaagaaaggcaaggacacuugguacaaugugcaucucgagaacggguggaucuaccggcguaccuccaacaugccucuggacugggucggaaagacaaaagaguucaucgugaccacugaucuugaaaaggacggcacacccaaaaaggauaaagaagguaauauuaagcgcucuuuuagagccccaaaggaggacgauuggagccugguuaaaaagaaaaccgaagcugacauagaucagacgcacaagacuguagggaccuauaucuacgacacauugcucggaaacccuucccagaaaauuaggggccggcuggugcgaacuaucgagcgcaaguauuacaaggaggaauuaaaacugauacucgauaagcaaaaagaguuccauccagaacuucaggacagagcccuguaugcggcaugcgucgaggaauuguacaccauuaaugaggcccacaggaacaauaucggcaaccgggauuuuacauaucuauuccuggaggacauccucuucuaccagcgcccccugaagaguaaaaagucacuuauugacaauuguccuuacgaagagaaccacugccuggauaaggaaaccggggagaucaaauuuuucccagugaaguguauugcuaaaagccauccguuguuucaagaguucagacucuggcaguuuauagugaaucugaggaucuaucguaagggauuagcccaggacgucgauguuacgaacgaacugcuaaaaacugaggaagacuacguggcacucuucgauuggcugaaugguaagaaagagauugaccaaaaggcuuuucuuaaguaucccccuuucggcuugaaaaaggaaguagagaacuaccgguggaauuaugugcaggauaaaucuuacccaugcaacgagacacgaucccugaugcucgccagacuggaaaagugugacaucucaaucgaguuucuuaccaaagaaaaugaggaagcgcuguggcacauuuuguauagcgucgaggauaagaacgagauagugaaggcccuccagaaauucgcagacaagcauaaccugaaugcuaguuuuguugauguguuccagaaauuucccucuuucaagaaagaauacggguccuacagcgccaaggcuaucaagaaauuacugccucuaaugaggaugggaaaguauuggucggaggacucuauugauaaaggcacucgcgaacggauggacaagaucauuacaggugaguacgacgagaaaaucgaaaacagagucagggagaaggccauacaccucgcagauaucuccgaguucaaggggcugccacuuugguuggugugcuauauuguauacggccgccacucagaaaguaaagaaaucgccaagugggagagccccgcugacauugauuccuaucugaaaucuuuuaagcaacauagccuccgaaauccgaucguugagcagauaauuaucgaaacccugcgggugguccgugacauuuggaaacaggugggaaacaucgaugagauacacgucgaauuaggcagagagaugaagaauccugcggacaaaaggcgcaagaugacgcagcaaaucucagaaaacgagaauaccaaccugcggauuaaguaccuuuugacagaguuccucaaucccgaauaugagguggaaaacguuagaccauacaguccuucccagcaggauauccugaggauuuacgaggaaggggugcuaaauagcguaucuaaccugcccgaggagaucucagacauacucaaaaaguuuacugaaaccgaucugaaaaagcgaccaagucgcagcgagguccuucgguauaaauuguggcuggaacagaaguacagaucccccuauacaggagaggugauuccuuuagguaaacucuucacuccagcauacgaaaucgagcauguuaucccgcaaucuagguauuuugacgauucguucagcaauaaagugauuugugaggccgaagucaacaagcugaaauccaaucuucugggccacgaguuuaucgugaagcaucacggggaaauuguagaguugcccuucggcaaaaaggugaagauauuuaccguugacgaguacgaacaguucgucaaagauaacuauucacguacacgcggaaagaugaaaaagcuccugguggacgacaucccugaggaauuuguggcucggcagcuaaacgauaguagauacauuucuaaagucguuaagagccugcucuccaauaucgugagggagaagggugaagaggaggccauuagcaaaaacgugaucccaugcaccgggggcguaacugaccgacugaagaaagauuggggagucaaugacguguggaacaagauaauccuuccccgguuccagcgcuugaaugaacugacgggcacaaacaaauuuaccacuaugucauuaaauaaccacgagauuccugcaaugccacucgaacugcaaaagggguucaauaagaaaagaaucgaucauaggcaccaugccauggacgcuauuaucauagccugugcaaaccggaauauuaucaacuaccuuaauaacgagucugcgaccgcuaaggccgaacugucccgauaugaucuacagagacuccugugcgacaaagcaaagacagaugacaauggaaacuacaaauggguuauccgcaagcccugggccaguuucacccaggaugugcacggugucuuggaggacauuauagugagcuuuaaacaaaaccugaggguuaucaauaaggcuacuaaccacuucuuacauuauaaugaggaaggcaagaaaauuuuugugaagcaggagaaaggggacucuugggccauccguaaguccaugcacaaagauacaguauucggagaagucaaccuccggagaauuaagacgguggcacugaaugaggcuaugaagaacccgcagucaaucguggucaaagacuuuaagaggaaacuucuggaauugcucaaucugggcuucgaugccaagcgcaucaaaaaguacuuugaggacaaccgagagaccuggagugauauaaaucuaagcaagauuacuguuuauuacuucucgaaagacacaaaggauagauuuuucgcgacccggaaaccucuggacacauccuuugauaggaagaaaaucgaaaacaauauuacugacaccgguauccagaagauacuucuccgccaucuggaguugaaggauaacaauccagacauugccuucucucccgaugggaucgacgaaaugaaccguaauaucauucaacugaacaauggcaaauaucaccagccuaucauaaaggugagaugguacgagcaggcugacaaauucgcaguaggacagacgggcaacaagagcucaaaauuuguggaggccgcuaaggggaccaacuuauucuuugccgucuacgaaaguaauauucucgaugagaaaacaaacacuaucauuaagaagcggaauuaugcaaccaucccccugaacguggcgauagaaaggcaaaaacagggacuuuccguugccccagaggaagagaauggcaacgacccuauuuucgugcugucucccaaugauuuggucuaccucccaacaacugacgagcuggcuaacggugugguugcccagccgcuagauaaggaacgcaucuauaaaauggugagcuguaccgggaaugagggacauuuuaucccugcacgaauugcuaaccccauccugcagacgauugaacuuggcuccaauaacaaggcccaaaaagcauggacagacgagaugauaaaggaaaucugcaugccaauuaaggucgauagacucgguaauauccuggagucaagcaguuugcacaaaaaguga

SEQ ID NO: 3415 - RNA, 4515 nt, Artificial Sequence
  Cas9 variant
augaagaacaucgugggccuggaccucgggaccaauagcauuggaugggccgucguuaacgguuccgugaaugaugacggcucugagcagcuuguaaaaauacaggcuucagggaguagaaucauucccauggaugcagccaugaucggagacuucaacaagggcaauagcauuucccaaacagcggaaaggacucggcugcgcggugugcgacguuugucugagagauacuuacugaggcgggaacgccuacacagaauccucgauauacugggguuucuuccuuuccauuuugcucaggaccuggauaggcacggaaaaaucgucaagggcaaagagccaaaguuggccuggcggaagaacgaagcaggccaguucgaguuuauuuuccaagacucguuuaaagagaugcucgaagauuucaagcugaauuauccgaaccugaucacggacgauaaaaaggugcccuacgacuggaccauuuauuaccuccgcaaaaagggguuaacaucaaagaucagcaaagaggaacuggccuggauacuuuugaauuuuaaccagaagcgaggauauuaccagcugagaggugaggaggaagaggaaaauaaagauaagcuaguugaguucuaugcucucaaaguggucgcaguggaagacaguggcgagaagaaagggaaggacauuugguacaacguacaucuggagaauggauggguuuacaggcggacuuccaacaugucucuugauugggugggcaagaccaaagaauuuaucgucacaaccgaccuggagaaggaugguacuccuaaaaaggacaaagaagggaaugugaagcguagcuuccgcgccccaaaggaggaugacugguccuuggugaaaaagaaaacagaagcugauauugaccagacccacaagacggucggagccuauaucuacgauacucuccugggcaaccccucacaaaagaucagaggcagguuaguucggaccauugagcgaaaguauuacaaggaggaacugaaacucauacuugagaagcagaaagaauuucaucuggaguugcaggaccgcgcgcuauaugcagccugcaucgaggaacuguacccuauuaacgaggcucacagaaauaacguggggaauagggauuucacauaucucuuccuggaagacauccuuuucuaccagcggccacugaagaguaaaaagagcuugauagacaacugucccuacgaggaaaaucaaggacucgauaaggagacuggugagauuaaaucuuucccuguaaagugcaucgccaaaucccacccacuguuucaggaauuucgcuuauggcaguuuaucauuaaccugagaaucuauaggaaggaccuagcacaagauguggacgucaccaaugagcuccugaaaacagaagaggauuacguggcucuuuucgacugguugaacggcaagaaagaaauugaucagaaggccuuucugaaguauccgguuuucgggcucaaaaaggagauagagaauuaccguuggaacuaugugcaggacaaacccuacccuuguaaugaaacccggucacugaugcuugcgcgacuggagaagugcgauaucagcauugaauuuuugacgaaagagaacgaagaggcccucuggcauauccuguauagugucgaggacaagaaugaaaucgugaaggcauuacagaaauucgcugauaagcacgaccugaacgccucuuuuguagauguuuuccaaaaauuuccacccuucaagaaagaguacggauccuacagcgcuaaggccauuaagaaacuacucccucugaugagaaugggcaaguauuggucggaaaauucuauagacaaagguacuagggagcgcaucgacaagauuaucacaggggaauacgaugagaaaauugagaaccgggugagagaaaaggcaauccaucuugccgacgucuccgauuucaagggcuugccacuguggcucguguguuauauagucuacggaaggcacucagaggcuaaagaaaucauucaguggaagagucccgcggacaucgauagcuaucugcgcuccuuuaaacagcacucuuuacgaaacccgauuguggagcagaucauaauugagacccugcggguugugcgugacaucuggaagcaaguaggcaauauugaugaaauccaugucgagcuugggagagaaaugaaaaacccugcagacaagaggaaaaagaugacucagcagaugagcgagaaugaaaacacaaauuugcgcauaaaguaccuccugaccgaguuccuaaaccccgaguaugaaguggagaauguucggccauacucaccuagucagcaagauauccugagaauuuacgaagagggagugcucaacuccgucagcgaccugcccgaagagaucucugauauucuuaaaaaguuuacggagaccgacuugaaaaagaggccaucacgaagugaagugcugcgcuauaaauuauggcucgagcagaaguaccggagccccuauacaggugaaguaaucccucugggcaaacuuuucacuccagccuacgagauagaacacgugauuccgcaguccugcuauuuugaugacucuuucucgaauaaaguuaucugugaggcugaggucaacaagcugaaaagcaauuugcucgggcaugaauuuaucgugaagcaccauggagagauuguggaacugcccuucggcaaaaaggucagaaucuuuaccguugacgaguacgagcaguucgugaaggauaacuauuccaggacacguucaaaaaugaagaaacuacugauggacgauauuccugaagaguuugugacucgccaacucaaugacagucgguacauaucuaagguagucaaaagccugcuuuccaacaucgugagagaaaagggugaggaagaggccauuucaaagaauguuaucccaugcaccgggggcgugacagauagguugaaaaaggacuggggaauuaacgaggucuggaacaaaaucauacugccccgauuccagcgguuaaaugaacucaccggcacuaacaaguuuacgaccaaaaauguggggauccaggagauuccuacaaugccacuggaacuucaaaagggauucaacaagaaacgcaucgaucacagacaccaugcaauggacgccauuaucauagcuugugccaauaggaacauuaucaauuaccugaacaaugagagcgcaacugcgaaggcugaacuaucucgguaugaucuccagaaaaugcugugcgacaaggccaaaaccgauaacaaugguaacuacaaguggguuauccgaaaacccugggcauccuucacacaggacaccuauuuggcccuggagaauauuauagugaguuuuaagcagaacuuaagaguaaucaauaaggcuacuaaccgcuuccuccacuacaacgaggaaggcaaaaagauuuuugucaaacaagggaagggagacaauugggccaucaggaaaagcaugcauaaggauacaguguucggcgaggugaaccugcgucggauuaagacggucgcacuuaaugaagcuaugaaaaacccgcagucuaucguugugaaggacuuuaaaagaaagcuguuggagcucuggaaucuggguuucgaugccaaaaggauaaagaaguauuuugaagacaaccgcgagaccugguccgauaucaaucuaucaaaaauugagguauacuauuucaguaaggacacuaaagaucgauuuuucgcgacaagaaagccucuggacaccagcuuugaucggaaaaagaucgaaaacaauauuacagacacugggauccagaagauacuucucaggcaccuggaguugaaagauaacaauccagacauugccuucucgcccgauggcaucgacgaaaugaaccgcaauaucauucagcugaacaauggaaaguaccaccaaccuaucauaaaaauucguugguacgagcaggcugacaaguucgcagugggccagaccgggaacaaauccucuaaguuugucgaggccgcuaaaggaacgaauuuauucuuugccguguaugaaagcaacauccucgauaagaagaccaacacaauuaucaaaaagagaaauuacgcaacuauaccccugaacguugcgauugagcggcagaaacaaggccuuccaguggccccugaagacgagaaugguaacgaucccaucuucguccugucaccaaaugacuugguguaucucccgaccgaugacgaacuggcuaacgggaucauugcccagccucuagauaggggacgcaucuacaagaugguuaguuccucuggcgagcagugcuuuuucauuaaacauauaguggcaaauguccugguagacaaguuugaguucagcccccuuaacaagauggaacgagcucucacaggugagaugaucaaaaugauuuguaucccaaucaagguggauagacugggcaauguuuuggaauccucaagcaguuauaaaaaguga

SEQ ID NO: 3416 - RNA, 4515 nt, Artificial Sequence
  Cas9 variant
augaagaacaucgugggccuggaccucgggaccaauagcauuggaugggccgucguuaacgguuccgugaaugaugacggcucugagcagcuuguaaaaauacaggcuucagggaguagaaucauucccauggaugcagccaugaucggagacuucaacaagggcaauagcauuucccaaacagcggaaaggacucggcugcgcggugugcgacguuugucugagagauacuuacugaggcgggaacgccuacacagaauccucgauauacugggguuucuuccuuuccauuuugcucaggaccuggauaggcacggaaaaaucgucaagggcaaagagccaaaguuggccuggcggaagaacgaagcaggccaguucgaguuuauuuuccaagacucguuuaaagagaugcucgaagauuucaagcugaaucauccgaaccugaucacggacgauaaaaaggugcccuaugacuggaccauuuacuaucuccgcaaaaagggguuaacaucaaagaucagcaaagaggaacuggccuggauacuuuugaauuuuaaccagaagcgaggauacuaucagcugagaggugaggaggaagaggaaaauaaaaacaagcuaguugaguucuacgcucucaaaguggucgcaguggaagauaguggcgagaagaaagggaaggacauuugguauaauguacaccuggagaacggauggguuuacaggcggacuuccaauaugccucuugacugggugggcaagaccaaagaauuuaucgucacaaccgaucuggagaaggacgguacuccaaagaaggauaaagaagggaacgugaagcguucuuuccgcgcccccaaggaggacgauuggagcuuggugaaaaagaaaacagaagcugacauugaucagacccauaagacggucggagccuacaucuaugacacucuccugggcaacccuucccagaaaaucagaggcagguuaguucggaccauugagcgaaaguacuauaaggaggaacugaaacaaauacucgagaagcagaaagaauuucaccuugagcugcaggaucgcgcguuguacgcagccugcaucgaggaacuauauccaauuaaugaggcucacagaaacaauguggggaacagggacuucacauaccuguuccucgaagauauccuguuuuaucaacggccccuuaagagcaaaaagagucugauagacaauuguccuuacgaggaaaaccagggauuggacaaggagacuggugagauuaaaucauucccaguaaagugcaucgccaaaucucauccgcucuuucaggaguuccgccuguggcaauuuaucauuaauuuaagaaucuacaggaaggaucuggcacaggacguggaugucaccaacgaacuacucaaaacagaagaggacuauguggcucuguucgauuggcuuaauggcaagaaagaaauugaccagaaggccuuuuugaaguaccccguuuuccgucugaaaaaggagauagagaacuaucgguggaauuacgugcaggauaaaccuuauccauguaacgaaacccgaucccucaugcuggcgagacuugagaagugcgacaucucaauugaauuucugacgaaagagaaugaagaggccuuguggcacauccucuacagcgucgaggauaagaacgaaaucgugaaggcacugcaaaaauucgcugacaagcaugauuuaaaugccaguuuuguagacguuuuccagaaauuucccccuuucaagaaagaguaugggucuuacuccgcuaaggccauuaagaaacugcuaccacucaugaggaugggaaaguacuggagcgaaaacucgauagauaaaggcacucgcgcacggaucgacaagauuaucacaggugaguaugacgagaaaauugaaaacagagugagggagaaggccauccaccuggcugaugucucugacuucaaggggcuucccuuguggcugguguguuacauagucuauggccgccacuccgaagcgaaagagaucauucaguggaagucaccggcagauaucgacaguuaccuccggagcuuuaaacagcauucccugcgaaauccuauuguggaacaaaucauaauugagaccuuacguguugugagagauaucuggaagcagguaggaaacauugacgagauccacgucgaacugggcagggagaugaaaaaucccgccgauaagcgcaaaaagaugacucagcagaugucugaaaacgagaauacaaaccuucggauaaaguauuugcucaccgaguuccugaauccagaauacgagguggaaaacguuagaccuuauagccccucacaacaggacauccuaaggauuuacgaggaaggggugcugaauagugucuccgaucucccagaggaaaucagcgacauucugaaaaaguuuacggagaccgaucuuaaaaagcgacccucucgcucagagaucuugcgguacaaacugugguuagaacagaaguauagaaguccuuacacaggagaggugauaccacucgguaagcuguucacuccggcuuaugaaauugagcauguaaucccccagagcugcuacuuugacgauuccuucucuaacaaagugaucugugaagccgagguuaauaaacuuaaaucgaaccuguugggccacgaguuuauugucaagcaucacggggaaaucguggagcucccuuucggcaaaaaggugaggauuuuuaccgucgacgaauaugagcaauucguuaaggacaauuacagccguacacgcuccaaaaugaagaaacugcuaauggaugacauaccagaggaauuugugacucggcagcugaacgauucaagauauaucaguaaggugguaaaaucucuccugagcaauauugucagggagaagggagaagaggaagcaaucuccaagaacgugauucccugcaccggugggguuacagaccgacuuaaaaaggauuggggcaucaacgagguguggaauaaaauaaucuugccucgguuccagcgccugaacgaguuaaccggaacuaauaaguuuacgaccaaaaacgucggccuccaagaaauuccaacaaugccccuggagcuucagaagggguucaauaagaaaagaaucgaccacaggcaucacgccauggaugcuauuaucauagccugugcaaaccggaauauuaucaacuaccugaauaacgaaucagcgacugcuaaggccgagcuaagccgauacgaccuccagaaaaugcugugcgauaaggcaaaaaccgacaauaacggaaauuauaagugggugaucagaaaaccgugggccucuuucacacaggauaccuacuuggcucuggaaaacauuauaguuuccuuuaagcaaaauuuacgcgugaucaacaaggccacuaacagguuccuccauuauaaugaggaggguaaaaagauuuuuguaaaacagggcaagggggacaacugggcaauccguaaaaguaugcacaaggacacagucuucggagaagugaaucugcggagaauuaagacgguggcucuuaacgaggccaugaaaaauccucagagcaucgucguuaaggauuuuaaaaggaagcuguuggaacucuggaaccugggcuucgacgcgaaacgcauaaagaaguacuuugaggauaaucgagaaaccuggucugacaucaaccuauccaaaauugagguguauuacuucucaaaggauacuaaagacagauuuuucgccacacggaagccacuggauaccaguuuugacaggaaaaagaucgagaauaacauuacagauacugguauccagaagauacuucuccgccaccuggaauugaaagacaauaaccccgauauugcuuucagcccugacgggaucgaugagaugaaucguaacaucauucaacugaauaacggcaaguaucaucagcccaucauaaaaguaagaugguacgaacaggcagacaaguucgccgugggacagaccggcaauaaauuuucgaaguucgucgaggcugccaaagggacgaacuuauuuuucgcaguguacgaguccaacauucucgacaagaagaccaauacaaucauuaaaaagcggaacuaugcgacuaucccacugaauguugccauagaaaggcaaaaacagggacuuccuguggcucccgaggaugaaaacggcaaugacccaauuuuuguccugucuccgaacgauuugguguaccucccuaccgacgaugagcuggccaaugguaucaucgcacagccccuagaccgcgggcgaauuuauaagaugguuagcucaaguggagaacaauguuucuuuaucaaacacauuguggcuaacguccugguagauaaguucgaguuuuccccacuuaauaagauggagagagcccucacaggcgaaaugauaaaaaugaucugcauucccaucaagguggaccggcuggguaacguuuuggagucuagcuccucacauaaaaaguga

SEQ ID NO: 3417 - RNA, 4515 nt, Artificial Sequence
  Cas9 variant
augaagagaauccugggccucgaccuugggaccaacagcauuggaugggcccugauagagaaugauuucaacaggaaagaagguaagaucgaggcuuugggcucccggauuauccccaugucucaggacauuuuagggaaauuugauucaggagugacagucagucaaacugcagcccgcacgaauuaccgaggcauccguagacuguaucagagggacaaccuacggcgcgaaagacuccacaggguucugaauauacuugguuuccugccuaagcauuacgcggagagcaucgauuuugaagaccgguuggggcaguucaaaccagagaccgaggugaagcucccguaucgcaaggauuccgacgauaacuaccacuuuauuuuccaggaaucuuuuaaugagaugguagaagaguuccaauuuaaaaaccccucgcuguucuauacaaaggcuaauggagagcagucaaaaaucccuuacgacuggacucuguauuaccuccgaaagaaagccuuaagcaagaagauuaguaaagaggaacuggcauggauccuuuugaacuuuaaucagaagagaggcuacuaucagcugaggggcgaagaggaagccgauuccaaagacaagcuagaggaguaccaugcucucaaagugucugauguccaagcaaccgaagacacaaacgccaaggggaccugguauaaugugauacuggagaacggauggauuuaccggcgucagagcaaagacucccuuuucgauuggaaggguaagacucgcgaauuuaucguuacaaccucacuggagaaaggcggggcugugaagauugacaaagaaggaaaugagaagagaaguuucagggccgucgauagcgagaaagacuggaucgcgaucaagaagaaaacggaaaacgauuuggcaaacgccggcacuaccguggguguauauauuuacgagacacuccugcggaauccagaccagaagauacgagggaaauuaaucaagacuauugaacgcaaauauuaccuggaggaacucaaggcuauccuugccaagcagauacaagagcacgcagagcugcagaacagaucuuuguacaaagauugcauugaggaacuauaucagggaaaugaagcucauaagaacaauaucaaagagaacggcuucgacuaccuguuucucgaggauaucauuuucuaucaaaggccccugaaguccaaaaagucaaccaucagcaauuguccuuacgaaagucggguuuuuauuaaggacggcaaaaaggagauacagccaaucaaaugcauuucuaaguccaaccccaucuaucaggaguuccgccuuuggcaguuuauccacaaucugaaaauuuacgaaaaggaagccauagaugacgggaaaacagugaucaacaaggacgucaccacggaguucuugaauacucaagaggcguaugccgcacucuuugaguuccugaacgauaaggcugaaauuagccagaaugccuuacugaaauacuuuaagcuaucgacaaacacccacagauggaauaacguggaagacaaaaaguacccuuguaacgagacuaggucugaauuuaucaaacgucucuccaagauggauggaauugaccuggguaagacacuuucaccagcuuuugagaaaaguuuguggcauaucauauauagcgugaaggauaaaaagcaguacguccgggcccuggagaccuucgcaaugaaaaauggccucgacaucaaccaguuucgagaaaauuucgagaaguucaagccguaugauuccgccuacggggcuuauucugaaaaagcgcugaagaaaguucuuccccugauuagaaggggaacguacuggaagaaagacgcaaucccugccgcugugcaagagcgcauuguaaacaucaugaagcggauagaaagcguggauuuuaauuuggagaagauugagaacuucgccgacgaugacaucccaaaacagcuccugaagucauuugcaaaaggcaaggaucccaugcaggguuuaaauaccuaucaggccugcuacgcugucuacaacagacacagugaaguguccgacauucaacuguggaaaagcccugaggacaucacaaaguaucuagauucuuucaaacagcauucacucaggaauccaauaguugaacagguggucauggagacucugcgcgugguacgagacaucuggcaguacuaugggaacggcgccaaggauuucuucagugagauucacguugaacuuggacgggagaugaagaaugacaaaaagacccgugaaagaaucagcaaauccauuacagagaacgaaaauacuaacgagaggaucaagaauauauugaaagagcugaugggcgaugaagcacuccaaggggacauucgccccuacucuaagggacaccaggauauccugaaguuauaugaggaagguguguuugcgaacgcuccggagaccuacaaaaacaucaagauugacgauaucgaaaagauucggaagaauaacucgccuagcaaauccgacauagucaaguauaagcuguggcuugagcagggcuacaucucacccuacacagggaguccaauuccuuugucuagacucuucaccacugauuaucaaaucgagcauauuauccccaggagccgauacuuugacgauuccaugggaaauaaaauaaucugugaaucagccgugaacgaggaaaagacgaauaaaacagcauaugaguucauuaaggaaaacgccggccgcaucauugaccugggucaggggaaacaggucccacuauuugaccuggaggcuuacgagagccacugccggggcuauuucaagggaaauaccaagaaacucaaguuucugcuuucugaagauauccccgagggcuucauaaacagacaguugaaugacuccagguacauuaguaaagugguuacuagccuguuaucuaacgugguacgugaagagggggagcaagaagccaccuccaagaaucucgucccucuggugggaacaaucaccucaaaacuuaagaaggauuggggucuggaggcaaucugggacgauuugauugcuccacgcuucgaacggaugaaccagcucacuaaaaguacagacuuuagaaaggagguuauagauggccaugggaauagguauuucaucaacacggugccggacgauauuaaaaagggauuuagcaaaaagcgaaucgaccaccggcaucacgcccuggaugcgcuagucauugccuguaccacuaaagaccacgugaauuacaucacaucgcugaacacccagcgcaacaauagaucccucguaucuaagcugaggaagauagaagagaaaacaaucaaggacaaacggacuggccagcccaagaccauuaaaaucgcuaaggcauaccauaagccuuggccaaacuucacgaaagagaccuuugaaaaacuuagcaaaacagugguuucauucaagcaaaaucagcgaauuaucaacaaaacuaauaacaagaccugggguugggagaaggucgauggggugaugaaaaagguguugaaaaagcaggagaaaagaaauugggccauacgcaagcccauucacaaggaaacauauuacggcaaagucaagggauuugacaguccuaaaggcaagaucacuaccgcuacgaggaaaucccugcgugaaaucacaaacgagcggcaguuaaauaccauuacugauucugggaucaagaaaauacucaacaaucaucugaagacauucauugacgagagcggaaagaucaacuuugaaccagccuucaaucaagauggcauugaccuucugaacaaaaauauccagcagcuaaacgaggguaagaaucaccaacccauauauaaaguuagaauguacacccacaacacuauguuuuccgugggggaugaaggaaacaagucaaccaaauaugugauuccggagagcggcacaaaucucuucuucaacguauacugggacgaagagaauaacaagaggaauuuugagacggucccucugaaccgcgugaucgcauuccagaagcagaccagucauaucccacgaaaagauagaacugacguucccauugauaauacauugggucgguuucuguucaccuuaucuccugacgaucucguguaucugcccacagacgaagaguccgagagcuuuacuaccuucgaaaucgacucgcuuaacucaaagcaggucgcgaauauuuacaaauuuguggauggcucugggacgacaggaaacuucguuccagccgaggcugccagggugauagcaaauaucaaggacaaaaagguacgcaguaacuuuugcaagcguaauaaccuguccgauaaacaauugauuaagaaugaguucggccucgggagcccucagcugaaaaaccagaacucucuagacggaagacagaucaagagcaucuguuggaaacuggaaauuaaucggcuuggcaagauaaucaaggucauuaaauga

SEQ ID NO: 3418 - RNA, 4515 nt, Artificial Sequence
  Cas9 variant
augaagaaagugcugggccucgacaucgggaccaacagcgucggaugggccguugugaaucagaacgauaagggugaguuccuuuccauugaaaagauaggcucuagaaucauucccaugucacaagacguaauggauaaguuuggggcuggacagacagagaguagcacugcacagaggacgcaguaccggggcgugcgccgacugcgugaaagauccuuguuaaggcgggagcgccugcacagaguccuacauauccuccacuuccugccucaacauuaugacgccgcgauugguuggaauaaaaaggaaaacaagaccuacgggaaauuucuuccaggaguggagguuaauaucccguggguggcuacagaucagggccaccaguucauauuuauggacucuuaugccgagaugcugaaggauuugaaacagcaucaaccccaccucuucgaaaagucgucaacuccugucccacuggacuggaccaucuacuaucugaggaaaaaggcacucacacaggccauuagcaaggaggaauuagcuuggauccugcuuaacuuuaaucagaaacggggcuacuaucaguugcgcggggaggagguggaagauaacaccaagcgagaggaguucuacgcacugaaaguaguuaagguggaacuagacaaagauaauacaagugccaagacaugguacaaaguccaccucgaaaacggauuuauuuaucccugcccuuccgacaccccaaucgauucuuggguggguauggugaaggacuucauagucacgacuacccuggagaaggacggcagcgagaaaagaacagcugauggggaaauuaagagguccuuucgggcccccaaagaggacgauuggacucuucugaagaaaaagaccgaaucagaguuggaaaagaguggaaaacaaguuggcgcguucaucuacgacacacuccugagcaauccugaucagaagauuaucgguggguuaaucaaaaccauugagcguaaguauuacaaaaaggagcuggaacagauacucgagacgcaacagaaguuuaucgcagaacuuucugacaaaaagcuguuccaggccugugcugaggaauuguauccacuaaacgauucccaucgcgagaaucugcucgagagagacuucaaacaccuguuugugcaggauauuaucuucuaccauaggccgcuuaagacuaaaaagucacugauaagcaacugcacauaugaauaccggaccuuuuacaagaauggagagaaacaaauuagucccaucaaguguaucgccaaaucuaacccuuuguuccaggaauuucgaguauggcaguucgugcagaaccuccgcauucugcaaagacagagguccgagggcgacagcaucaaguauaaugucgaugugacugcagaguuuuuaaaagacgaaaacgacauugcuaaucuguucacauggcuaaacgagcggaagguuauaaaacaggaucagcuccugaagucguacuuuaaacuuaaagugaauaaggaaaccaaagaguuggacuaucgcuggaacuacgucgaugacaagaauaaagaauauccaugcaacgccacgagaacccacauccugucuuuccucgagaaguguaaggaggaaaagaggauugaggaugaccguuuuguguacucccuguggcaccuucuguauucaguaguugaacccaucgaguugcggggcgcgcucgccaaguucgcagaacgagagcaucugcacccuaguuuuguggaugucuucgcucaauucccacccuuagagaaagaauacgggagcuacuccgagaaggccaucaaaagacugcuaccgcucaugaggaugggagacuauuggcaugaagauaagauugacgugaagacaaaacagcgcauacagcggaucauugauggugaggcugacgaugacaucacucacagaucuagggaaaaggucgagaaucugcgcagcauuaccgacuuuaaaggccuuccuuuguggaaggccggguacgugguuuauaaccgacauucagagaguggagaacugacaaaauggaagacuccccacgagcucuccaauuacauccagaacgaguucaagcaauauagccugcggaauccaauaguggaacagaucguauuagagacccugcgugucgugcacgaucuuuggguuaaacauggcgacuuuucugaaauucacuuggagcucgguagagauaucaagaacucaagugacaaaaggaagcgcauggcagaacggcagcaagagaaugaaaacagcagacagagggugcuggagaugcuaauugaucugaaaaaggaggccgcuuucgcggaccucaacccuuacucccccucucagcaggaaaaacugcgaaucgucgaggauggggugcuucgcucgaauauagaaauuccaaaggacaucgagaagauuacaaaaagcgcaaagcccaccucccgggaauugacuaaauauagacugugguuagaucaaaaguacaggucaccuuacacgggccagccaaucagucucgcccagcuguuuacaucuaaauaugagauagagcauguaaucccgcaggcuaaguacuucgacgauagcuuuaccaacaaggugauuugcgaauccgagguuaauaaagaaaagggaucaaugcuugcccacgaguucauccugaaaaacggcgggagcacugucaaugugggaggucgucaagugcaggucuugaagaacgacgcauauguugaacucauuaaucgccuguacggcaaaaacaaucccgugaaggccaagaaacuacuggcugaggauaucgacgaggugguaggggacuuuucugaacggcagcucaacgauaccagauauauauccagggucgugcagaagcugcuuaguaauauuguucgagaggaagacgagcaagagagcacaucuaaacacgugaucggauguuccggccaggucaccacugccuugaagaaagauuggggucugaacgacaucuggaauaagauuauccagccucgguucgaacgcuuaaacgagaugacagcaacggaagauuacgggguguggcaaucaccaaaucauuuucagauuagaguucccgaggaaauacagaagggcuucaccaaaaagaggaucgaccaccggcaucacgcgauggaugcucucgugauugccugcgcaacucgaagucauaucaacuauauuagcaacagaucgggacaggaccgcaaugccaaauuugagacaaccaggacagaucugcguuccaaacuuuguuacaaagagaacucuagcggcaauaacuacaauuauaucuucaacaagccuugggacacuuucacccaagaugcucaccgggcccuggaaaauauaguagucucacacaagcagaaccuaagagugcucacgaaaaccaauaacuacacacaguuuaucaauaaggacgggaaaaaggaccugcagaaacaagugaagggagaucauuucgcagucaggaaaccaaugcaccaggagacuauuuauggucgcguuaguauccgauccauuaaggaaguggcuuugaagaaagcccuggagaacuggaagcagaucguagacagaaccuuaaaagauaagauacgggaacucauuggcgcguacgggaaauaugacgcccagacaauccugaaguacuuuaaggauagggacuauaaauucaauaaccuuaagaucaaucgcguggaggucuacgaguacgaucauaacugcgcugcagugcguaaaucuauuggagacgaucugacuauaaagcaaaucgaaagaauuaccgacgagagcauccggaaaauuuugaugaaccaccucuccaauuaugaugacaaccugaaggaagccuuuucacccgagggccuaauggaaaugaauaagaacaucaaagagcugaauggugggaagaaccaucagccgauauacaaaguuaggcuuuucgaggaucucggcagcaaguuuccucugggagugagucacaauaacccagacaaauaugcuaucgccgcaaagggcacgaauuuguucuuugggauuuacgaagaccaggagggaaagcgcauguucgauucuaucccccugaacauugucaucgaccgauuaaaagaaaagaaauccccugugcccgagacauauaaugagagcaagcucaaauuucaccugucgccaaacgaucuuguuuacgugccuaccgacgaggaacagaagcaacccgaacuggucgauguagaccauuugucagaugagcagaaaggcagaguguauaaggcgguuucuuucacugguaaucgggccuucuuugugaaccacagggucaguaaggugauacaugacuacguagaguucgggacuaaaaauaagauugaaaacgaugacgauaaacgcucccucaagcacaucuguuggaaacugaaggugaauagacuaggagagaucaccgacgucaagagguga

SEQ ID NO: 3419 - RNA, 4515 nt, Artificial Sequence
  Cas9 variant
augaagaacaucgugggccuggaccucgggaccaauagcauuggaugggccgucguuaacgguuccgugaaugaugacggcucugagcagcuuguaaaaauacaggcuucagggaguagaaucauucccauggaugcagccaugaucggagacuucaacaagggcaauagcauuucccaaacagcggaaaggacucggcugcgcggugugcgacguuugucugagagauacuuacugaggcgggaacgccuacacagaauccucgauauacugggguuucuuccuuuccauuuugcucaggaccuggauaggcacggaaaaaucgucaagggcaaagagccaaaguuggccuggcggaagaacgaagcaggccaguucgaguuuauuuuccaagacucguuuaaagagaugcucgaagauuucaagcugaauuauccgaaccugaucacggacgauaaaaaggugcccuacgacuggaccauuuauuaccuccgcaaaaagggguuaacaucaaagaucagcaaagaggaacuggccuggauacuuuugaauuuuaaccagaagcgaggauauuaccagcugagaggugaggaggaagaggaaaauaaagauaagcuaguugaguucuaugcucucaaaguggucgcaguggaagacaguggcgagaagaaagggaaggacauuugguacaacguacaucuggagaauggauggguuuacaggcggacuuccaacaugucucuugauugggugggcaagaccaaagaauuuaucgucacaaccgaccuggagaaggaugguacuccuaaaaaggacaaagaagggaaugugaagcguagcuuccgcgccccaaaggaggaugacugguccuuggugaaaaagaaaacagaagcugauauugaccagacccacaagacggucggagccuauaucuacgauacucuccugggcaaccccucacaaaagaucagaggcagguuaguucggaccauugagcgaaaguauuacaaggaggaacugaaacucauacuugagaagcagaaagaauuucaucuggaguugcaggaccgcgcgcuauaugcagccugcaucgaggaacuguacccuauuaacgaggcucacagaaauaacguggggaauagggauuucacauaucucuuccuggaagacauccuuuucuaccagcggccacugaagaguaaaaagagcuugauagacaacugucccuacgaggaaaaucaaggacucgauaaggagacuggugagauuaaaucuuucccuguaaagugcaucgccaaaucccacccacuguuucaggaauuucgcuuauggcaguuuaucauuaaccugagaaucuauaggaaggaccuagcacaagauguggacgucaccaaugagcuccugaaaacagaagaggauuacguggcucuuuucgacugguugaacggcaagaaagaaauugaucagaaggccuuucugaaguauccgguuuucgggcucaaaaaggagauagagaauuaccguuggaacuaugugcaggacaaacccuacccuuguaaugaaacccggucacugaugcuugcgcgacuggagaagugcgauaucagcauugaauuuuugacgaaagagaacgaagaggcccucuggcauauccuguauagugucgaggacaagaaugaaaucgugaaggcauuacagaaauucgcugauaagcacgaccugaacgccucuuuuguagauguuuuccaaaaauuuccacccuucaagaaagaguacggauccuacagcgcuaaggccauuaagaaacuacucccucugaugagaaugggcaaguauuggucggaaaauucuauagacaaagguacuagggagcgcaucgacaagauuaucacaggggaauacgaugagaaaauugagaaccgggugagagaaaaggcaauccaucuugccgacgucuccgauuucaagggcuugccacuguggcucguguguuauauagucuacggaaggcacucagaggcuaaagaaaucauucaguggaagagucccgcggacaucgauagcuaucugcgcuccuuuaaacagcacucuuuacgaaacccgauuguggagcagaucauaauugagacccugcggguugugcgugacaucuggaagcaaguaggcaauauugaugaaauccaugucgagcuugggagagaaaugaaaaacccugcagacaagaggaaaaagaugacucagcagaugagcgagaaugaaaacacaaauuugcgcauaaaguaccuccugaccgaguuccuaaaccccgaguaugaaguggagaauguucggccauacucaccuagucagcaagauauccugagaauuuacgaagagggagugcucaacuccgucagcgaccugcccgaagagaucucugauauucuuaaaaaguuuacggagaccgacuugaaaaagaggccaucacgaagugaagugcugcgcuauaaauuauggcucgagcagaaguaccggagccccuauacaggugaaguaaucccucugggcaaacuuuucacuccagccuacgagauagaacacgugauuccgcaguccuauuacuuugaugacucuuucucgaauaaaguuaucugcgaggcugaggucaacaagcugaaaagcaauuugcucgggcaugaauuuaucgugaagcaccauggagagauuguggaacugcccuucggcaaaaaggucagaaucuuuaccguugacgaguaugagcaguucgugaaggauaacuacuccaggacacguucaaaaaugaagaaacuacugauggacgauauuccugaagaguuugugacucgccaacucaaugacagucgguacauaucuaagguagucaaaagccugcuuuccaacaucgugagagaaaagggugaggaagaggccauuucaaagaauguuaucccauguaccgggggcgugacagauagguugaaaaaggacuggggaauuaacgaggucuggaacaaaaucauacugccccgauuccagcgguuaaaugaacucaccggcacuaacaaguuuacgacaaagaauguggggauccaggagauuccuaccaugccacuggaacuucaaaagggauucaacaagaaacgcaucgaucacagacaccaugcaauggacgccauuaucauagcuugcgccaauaggaacauuaucaauuaucugaacaauaagagcgcaacugcgaaagcugagcuaucucgguacgaucuccagaagaugcugugugacaaagccaagaccgauaacaaugguaacuauaaauggguuauccgaaagcccugggcauccuucacacaggacaccuacuuggcccuggaaaauauuauagugaguuuuaagcagaacuuaagaguaaucaauaaagcuacuaaccgcuuccuccacuauaacgaggagggcaagaaaauuuuugucaagcaagggaaaggagacaauugggccaucaggaaaagcaugcauaaggauacaguguucggcgaagugaaccugcgucggauuaaaacggucgcacuuaaugaggcuaugaagaacccgcagucuaucguugugaaagacuuuaagagaaaacuguuggaacucuggaaucuggguuucgaugccaagaggauaaagaaauacuuugaggacaaccgcgaaaccugguccgauaucaaucuaucaaagauugagguauauuacuucaguaaagacacuaaggaucgauuuuucgcgacaagaaaaccucuggacaccagcuuugaucggaagaagaucgagaacaauauuacagacacugggauccagaaaauacuucucaggcaccuggaauugaaggauaacaauccagacauugccuucucgcccgauggcaucgacgagaugaaccgcaauaucauucagcugaacaauggaaaauaccaccaaccuaucauaaagauucguugguaugaacaggcugacaaauucgcagugggccagaccgggaacaaguccucuaaauuugucgaggccgcuaagggaacgaauuuauucuuugccguguacgagagcaacauccucgauaagaaaaccaacacaauuaucaagaaaagaaauuaugcaacuauaccccugaacguugcgauugaacggcagaagcaaggccuuccaguggccccugaggacgaaaaugguaacgaucccaucuucguccugucaccaaaugacuugguguaccucccgaccgaugacgagcuggcuaacgggaucauugcccagccucuagauaggggacgcaucuauaaaaugguuaguuccucuggcgaacagugcuuuuucauuaagcauauaguggcaaauguccugguagacaaguuugaguucagcccccuuaacaaaauggagcgagcucucacaggugaaaugaucaagaugauuuguaucccaaucaaaguggauagacugggcaauguuuuggaguccucaagcaguuacaagaaauga

SEQ ID NO: 3420 - RNA, 4515 nt, Artificial Sequence
  Cas9 variant
augaagaacaucgugggccuggaccucgggaccaauagcauuggaugggccgucguuaacgguuccgugaaugaugacggcucugagcagcuuguaaaaauacaagcuagcgggaguagaaucauucccauggaugcagccaugaucggagacuucaacaagggcaauagcauuucccagacagcggaaaggacucggcugcgcggugugcgacguuugucugagagauacuuacugaggcgggaacgccuacacagaauccucgauauacugggguuucuuccuuuccauuuugcucaggaccuggauaggcacggaaaaaucgucaagggcaaagagccaaaguuggccuggcggaagaacgaagcaggccaguucgaguuuauuuuccaagacucguuuaaagagaugcucgaagauuucaagcugaaucauccgaaccugaucacggacgauaaaaaggugcccuaugacuggaccauuuacuaucuccgcaaaaagggguuaacaucaaagaucagcaaagaggaacuggccuggauacuuuugaauuuuaaccagaagcgaggauacuaucagcugagaggugaggaggaagaggaaaauaaaaacaagcuaguugaguucuacgcucucaaaguggucgcaguggaagauaguggcgagaagaaagggaaggacauuugguauaauguacaccuggagaacggauggguuuacaggcggacuuccaauaugccucuugacugggugggcaagaccaaagaauuuaucgucacaaccgaucuggagaaggacgguacuccaaagaaggauaaagaagggaacgugaagcguucuuuccgcgcccccaaggaggacgauuggagcuugcucaaaaagaaaacagaagcugacauugaucagacccauaagacggugggagucuacaucuaugacacucuguuaggcaacccuucccagaaaaucagaggcaggcugguucggaccauugagcgaaaguacuauaaggaggaacucaaacaaauacuugagaagcagaaagaauuucaccuggaguugcaggaucgcgcccuauacgcggcaugcaucgaggaacuguauccaauuaaugaggcccacagaaacaauguggggaacagggacuucacauaccucuuccuggaagauauccuuuucuaucaacggccccugaagaguaaaaagucauugauagacaauuguccuuacgaggaaaaccagggacucgacaaggagacuggugagauuaaaucauucccaguaaagugcaucgcuaaaucucauccgcuguuucaggaauuucgcuuauggcaauuuaucgugaaucugagaauuuacaggaaggaucuagcccaggacgucgaugugaccaacgagcuccugaaaacagaagaggacuauguugcacuuuucgauugguugaauggcaagaaagaaaucgaccagaaggcuuuucugaaguaccccguguucgggcucaaaaaggagauugagaacuaucguuggaauuacguccaggauaaaccuuauccauguaacgaaacccggucccugaugcuugcccgacuggagaagugcgacauaucaaucgaauuuuugacgaaagagaaugaagaggcgcucuggcacauucuguacagcguggaggauaagaacgaaaucguaaaggccuuacaaaaauucgcagacaagcaugaucugaaugcuaguuuuguugacguguuccagaaauuucccccuuucaagaaagaguauggaucuuacuccgccaaggcuaucaagaaacuacucccacugaugagaaugggcaaguacuggagcgaaaacucgauugauaaagguacuagggagcgcauagacaagaucauuacaggggaauaugacgagaaaaucgagaaccgggucagagaaaaggccauucaccuugcagaugugucugacuucaagggcuugccccuguggcucgucuguuacaucguguauggaaggcacuccgaggccaaagaaauaacccaguggaagucaccggcugauaucgacaguuaccugcgcagcuuuaaacagcauuccuuacgaaauccuauuguugagcaaaucauuaucgagacucugcgggugguacgugauauauggaagcaggucggcaacauugacgaaauccacguggagcuugggagagaaaugaaaaaucccgcggauaagaggaaaaagaugacacagcagaugucugagaacgaaaauaccaacuugcgcauuaaguaucuccugacggaguuccuaaauccagaguacgaaguugagaacgugcggccuuauagccccucacaacaggacauccugagaauauacgaagagggaguccucaauaguguguccgaucugccagaagagaucagcgacauucuuaaaaaguuuaccgagacagauuugaaaaagaggcccucucgaucagaaauccugcgcuacaaauuauggcucgagcagaaguaucggaguccuuacacuggugaaguaauuccacugggcaaacuuuucaccccggcauaugagaucgaacaugugauaccccagagcugcuacuuugacgauuccuucucuaacaaaguuauuugugaggccgaggucaauaagcugaaaucgaacuugcucgggcacgaauuuaucgugaagcaucacggagagaucguggaacugccuuucggcaaaaaggucagaauuuuuacaguugacgaguaugagcaauucgugaaggacaauuacagcaggacucguuccaaaaugaagaaacuacugauggaugacaucccagaagaguuugugacccgccagcucaacgauucacgguauauuaguaagguagucaaaucucugcuuagcaauauagugagagaaaagggugaggaagaggcuaucuccaagaacguuauucccugcacagggggcgugaccgacagguugaaaaaggauuggggaaucaacgaggucuggaauaaaauuauccugccucgauuccagcgguuaaacgaacucacuggcacgaauaaguuuacaaccaaaaacguggggauacaagagaucccaacuaugccccuggaacuucagaagggauucaauaagaaacgcauugaccacagacaucacgccauggaugcaaucauuaucgccugugcuaacaggaauauaauuaacuaccugaauaacgagucagccaccgcaaaggcggaacuaagccgguacgaccuccagaaaaugcugugcgauaaggcuaaaacagacaauaacgguaauuauaaguggguuauccgaaaaccgugggccucuuucacccaggauacuuacuuggcacuggagaacaucauuguguccuuuaagcaaaauuuaagaguaauaaacaaggccacaaaccgcuuccuccauuauaaugaggaaggcaaaaagaucuuugucaaacaggggaagggagacaacugggcuauuaggaaaaguaugcacaaggacacgguguucggcgaggugaaucugcgucggaucaagaccgucgcccuuaacgaagcaaugaaaaauccucagagcauuguugugaaggauuuuaaaagaaagcuguuggagcucuggaaccuggguuucgacgcuaaaaggaucaagaaguacuuugaagauaaucgcgagacuuggucugacauaaaccuauccaaaaucgagguauauuacuucucaaaggauacaaaagaccgauuuuucgccaccagaaagccacuggauacaaguuuugaccggaaaaagauugaaaauaacaucacugauaccgggauucagaagauccuucucaggcaccuggaguugaaagacaauaaccccgauauagcguucagcccugacggcauugaugaaaugaaucgcaacaucauccaacugaauaacggaaaguaucaucagcccauuaucaaaauacguugguacgagcaggccgacaaguucgcugugggccagacggggaauaaauuuucgaaguucgucgaggcagccaaaggaaccaacuuauuuuucgcuguguacgaauccaacauucucgacaagaagacaaauacuaucauuaaaaagagaaacuaugccaccaucccacugaauguugcaauagagcggcaaaaacagggccuuccuguggcgcccgaagaugagaacgguaaugacccaauuuuuguccugucuccgaacgauuugguguaccucccuacagacgaugaacuggccaaugggaucaucgcucagccccuagacaggggacgcauuuauaagaugguuagcuguacuggcaacgagggucacuucaucccagcccgaauugcaaaucccauacugcaaaccaucgagcuuggcucaaacaauaaagcucagaaggccuggacggaugaaaugauuaaggagaucugcaugccuaucaaaguggacagacucgggaacguccuggaaaguuccucuagcuacaagaaauga

SEQ ID NO: 3421 - RNA, 4521 nt, Artificial Sequence
  Cas9 variant
augaagaccauccugggccucgaccuugggcccaacagcauuggaugggccaaaguggaggucgaugacgaagguaauuaccugagaaacauaaaguugggcuccaggaucauuccuaugacacaggauauguuaggggacuucgauaaaggaguuaaggugucucaaacugcuauccggacggacuuucgcggcaaucgacgucugauugagagacaccuacucaggcgggaacgccugcauagaguacuucacgcacugaaauucuugccaaagcauuaugaggaugccaucgguugggacaggaacgaaccggcgaccuacgggaaguuugugaauaacucagagcccaaacucgcuugggagcggcaggaagauggaaguaugcgcuuccuguuuauggagagcuucaaugaaauggucgccgacuuugcacagaaccagccuucccuggugucugauggcaagaaaauaccacucgacuggacaaucuauuacuuacgaaagaaagcccugacuagacccauuaagaaggaggagcuugcuuggaucuugcugaauuucaaccaaaaacggggcuauuaccagcuacggggagaagaggaagaggauaaucucaccaagcguaaagaauauuacaagcugaaaguugugggagucgaggcagacggugccccuaagggcgggaaaacaugguacaacauucaccuugagaauggauggaccgcucgcugccagucgaagaucccacuggacgauugggugggcaagguaaaagaauauauaguuacuacagaguacgaagacgaugguaagacccccaaaugugacaaggaggggaaagugaagagaucauuuaagagcccugaaaaagaugacuggcaguugauuaagacgaggacugagaaauucaucgaugacaguaacaagaccgucggagccuuuauuuaugauuaccuccuggagaaaccauucgacaagauccggggcaaguauauccgaacaauugaacgcaaauacuauaagaaugaguuaagagaaauacugagggagcaaacuaaauaccaugaaggccuccacucccuugaggcgcugaagaucugcgcagaggaauuguacaaaaacaaccagcagcaccaggaguaucuacugaagaaggauaugaccuuucuccugcuuaaugaccugauuuucuaccaacggccguugaaaucuaagaaaagccucaucgccgacugucccuaugaaguguacaaguaugaugacaaacugacagggaagaaaggacagaagaagauaaaaugcauugcuaaguccaacccuuacuaucaggaguuccgcuuauggcaauuuaucgccaaucugagacuauucucagugaccgaugguaaagaggucacggcagaauaccucaagacugaggaagacuacguuaggcuguuuaguuuccuuaacgaucguaaagacaucaagcaggagacauuuuugcggagcuuccugaagcucaaaaaggaaucuauuggcuccgagaaaaucuauccaauucgauggaauuacauagaggaugcuaacaagucauaucccuguaaugccaccagacaugaacugcuucuggcguuugacagggccgauaucccucgcgaguugcucgacguggaagagagggaauacagacuguggcacuuacuguauagcauugaggcaaaagaggaaacugagagugcucuaaggaagcucaaggccaacaaggcuuucggggaucugaauaucgacgaugccuuuguaaacucuuuccuuaaaaucaaaccauuugaaaaggaguacggagcauauuccgaaaaagccauuaagaaguugcuggcugugaugcgccgaggcagccucuggaaagaggcggacauaugcgaggcaacaaagcagaauaucgccaaaauucugcagaacgacaucgaugaaaagcugaaaaagaaaauugaggcugccgucucgucuuucaauaaguuauccgacuuucaaggucuucccaccugguuggcauguuacgugguuuacgggcggcauucagaagccgcucagauccagugcuggcagaguccggaggaucucaagacguauauaaacaaauucaagcaacacagccugcguaauccuaucguggagcagugucuacuggaaacccucagaacagucuacgacauuuggaaagaugccggccagaucgacgagauucacaucgaacugggaaggaacaugaaguccacugcagagcagcgcgcgcggaaaaccaaggauauacuuagaaacgaaaauacaaacuugaggauuaagaaucuguuaguggagcucaaaaacgacgauaagaucgagaauguacgacccuauucuccaagccaacaggaaauucugcgcaucuacgaggaaggcgcccuucaggagcugucaaaagaagacgagauguucgaggauauaaguaagaucuccaaaauggcucagccuagccccacugaauugucucgguauaagcucuggcuggagcaaaaguacagaucaccauauaccgggaggguuauuccccuaaguaaacuguuuacaaccgcauaccagaucgaacauauuaucccucagagccguuacuucgacgauuccuuuaacaauaaggugauaugcgagucugaagucaacucgcucaaagacaauaugcugggauaugaguucauuaaggagugugguggccgcaucgugcacugcacucuuuugggggacgucaaaaucuuuacgaaggaagaguacaaggauuucgugacaaaacauuauauugacaacaccuacaagcgggauaaacuguuacucgaagacaucccacaagaguuuagcgccagacagcugaaugauuccagguauauuucaaagaugguucagacugugcuuaguaacauaguacgagcugagaaugaacaggaggccaccucuaaauucgucgugagcugcaacggagcaaucacaaaucggcugaagaaggacuggggccuaaacgauguuugguccucaauuguguguccgcgcuuuaaaagacucaacgaaaucaccaagacuaaugcuuucggucacugggaggacaaagccgggaagcaugucuuucaaacaacggugccccuggaauugcagaggggcuucagcaaaaagcggauugaucaccgacaccaugcgauggacgcccugguaaucgcuugcgcaucuagaaacauagugaauuacuuaaacaaugaguccgccaacaguccugagaaacgcgaagaucucaggaagaagcugugugacgagaaacguaagauccggaaaccauggaagaccuuuacucaggacgcuagagaagcccuuagcgauguugucgugucuuucaaaaauuaugugagggucauuaacaaggcaacaaauuacuacgagcacuauuccucaaguggaaacaagguuaugaucagccagaaaggcaaugacaugugggcgauucgcaagccccugcauaaagaaucgguguucgggcgagugaacuugugcagaaagguaaucgucucccucaaaaaggcccuggagaauauaccugcuauuugugauaagacccuacgggacuacaucaacgcccugguggagaaacacuuuaauacaaggcaacuucucgcacacuucaagucuaucaacuaucgccugaaccgucagugcguugaaaaaguggaggucuggcaguuuagcgaugaaaagauugagaugguggcuagacggaaaucauuggacaccaguuucgaugacaagcagauauccucuaucacugauacggggauucaaaagauccuguuaaauuaccuccagaccaaagacgguaacgccgaaauugcauuuacaccagagggcaucgaggaaaugaauaagaacauaagccuguauaaugaugggaaagcccaucagcccauccuuaagguuaggguggcuacuccgaaaggaaugaaguacccuguaggccaaaccgguaacaaagcgacaaaguucgucguggccgagaaggggacuaaucuguauuuugcaauuuacgaaaacgaguugggcgugcgcuccuacgacaccaucccacucaauauugucguugagcgacugaaagaaggacuaucacccgugccucaggcuaacgaggccgauaucccccugaaguucuaucuuagcccaaaugaccucguauacgugccuacgaaagaaaacgaggacgaacuguguagagaucggauauauaaguuugucgacaguucuggcacaaccgccaauuucgugccccacacuuccgcuaacacaauuuacaauguugauaaagaguaugcagagaagugcuguaacggggccguguuuuugaaugaauacggauuaggcagcccacagucgaagaaccagagggcgcugaccggugagaugaucaaagaaaucugcuggaagcucaaagucgaccgccuggggaacauuaucaaggugauaaaauga

SEQ ID NO: 3422 - RNA, 4530 nt, Artificial Sequence
  Cas9 variant
augaagaacaucgugggccuggaccucgggaccaauagcauuggaugggccgucguuaacgguuccgugaaugaugacggcucugagcagcuuguaaaaauacaagcaucagggaguagaaucauucccauggaugcagccaugaucggagacuucaacaagggcaauagcauuucccagacagcggaaaggacucggcugcgcggugugcgacguuugucugagagauacuuacugaggcgggaacgccuacacagaauccucgauauacugggguuucuuccuuuccauuuugcucaggaccuggauaggcacggaaaaaucgucaagggcaaagagccaaaguuggccuggcggaagaacgaagcaggccaguucgaguuuauuuuccaagacucguuuaaagagaugcucgaagauuucaagcugaaucauccgaaccugaucacggacgauaaaaaggugcccuaugacuggaccauuuacuaucuccgcaaaaagggguuaacaucaaagaucagcaaagaggaacuggccuggauacuuuugaauuuuaaccagaagcgaggauacuaucagcugagaggugaggaggaaaagaagaaugauaacguuaugauuaucaauaguaaagugauugacgucgugaaggcugagaaagacaagaaguacgaaaaauauugguacaacguacuacucgagaauggccugcuuuacagggcagccuucuauaacgauaucuccuuuuggaaggggcacacuaaagaguucguucugaagaccaucaaauugaagucuggaggcacaaagcaggaacucagcuuucugccuuccuucgacgagauugagaaaauggaaaagaaacaaaaggauaaaauguacuucaagauaaaguuaaaaaccgaagcugacaucgaucaggcccauaagacuguggguacauauauuuacgacacccugcucgggaacccaucacagaaaauccggggacgucuuguccgcacgauagagagaaaguauuacaaagaggaacugaaguugauucuagauaagcagaaagaguuucaccccgaacugcaagacagggcgcucuaugcagccugcaucgaggaacuguacccuaucaaugaggcucaccggaacaaugugggcaaccgagauuucacuuaccuuuuucuggaagacauuuuguucuaucagcgcccacucaagaguaaaaagagccugaucgauaauugucccuacgaggagaaccagggcuuagacaaagaaaccggggagauuaagucuuuuccugugaaaugcauagccaagucccauccacuguuccaagaauuuagacuauggcaguucaucgucaaucucaggauuuaucggaaggaccuggcacaggauguugacgugacaaacgagcuuuugaaaacugaggaagauuacguagcucuguuugacuggcucaauggaaagaaagagaucgaucagaaggccuuccugaaauauccgguguuuggucuuaagaaggaaaucgagaacuaccgcuggaauuauguccaagacaaacccuacccuuguaacgaaaccagacuguugaugcucgcgaggcuggagaagugcgauauuucaauagaguucuuaacaaaagaaaaugaggaagcccuguggcacauccuauacagcguggaggacaagaacgaaauuguuaaagcacuccagaaguuugcugauaagcaugaccugaaugccaguuucguggaugucuuccguaaauuuccacccuucaagaaagaguauggcucuuacuccgcuaaggccaucaaaaaguugcuuccucugaugcggauggggaaguauuggagcgaggacucgauugauaaaggaacccgaaagagaauggacaaaaucauaacgggcgaauacgacgagaagaucgaaaacagggugcgcgagaaaguaauucaccucgcagauguuucugacuuucggggucugccauuauggcugguguguuauaucgucuacgggagacacuccgaagccaaggagauuacucaguggaaaucacccgcugauaucgacaguuaucuuaagagcuucaagcagcauuccuugaggaacccgauaguggagcaaauuaucauugaaacacuccgcgucgugcgagauaucuggaaacagguuggcaauauagacgagauccacguggaacugggacgggagaugaagaacccugcggauaaacguaagaaaaugacccagcagaugucugagaaugaaaacacuaaucuaagaauuaaguaccugcucacagaguuucugaaccccgaauacgagguagaaaaugucaggccauauagcccuucacaacaggacauccuucgcauuuacgaggagggcguguugaacaguguuuccgaucugcccgaagagaucagcgacauauuaaagaaauucaccgaaacggaucucaagaaacggccaucuagaucagagauucugagguauaaacuuuggcuggaacagaaauaccgaagucccuauaccggggaggugaucccuuugggaaagcucuuuacaccagcauacgagaucgaacaugucauuccgcagagcugcuauuucgacgauuccuuuucuaauaaggugaucugugaggccgaaguaaacaaacugaagucgaaucuacugggucacgaguucauugugaaacaucacggcgaaauaguugagcuccccuuugggaagaaaguccgcaucuucacuguggacgaguacgaacaauuugugaaggacaacuacagccggaccagaggaaagaugaaaaagcugcuuauggaugacauuccugaggaguucgucgcuaggcaguugaaugauucccguuauaucucaaaaguugugaagagucuguuaucuaacauugugcgcgaaaaaggcgaggaagaggccaucagcaagaauguaauaccaugcacagguggggucacugaccggcucaagaaagauuggggcaucaacgaaguguggaacaagauuauccugcccagauuccagaggcuuaaugagcugaccggaacaaacaaauuuaccacuaagaauguuggcauucaagaaaucccuacgaugccacuagagcuccagaaaggguucaacaagaaacgaauagaccaccggcaucacgcaauggaugccauuaucaucgcuugugccaaucgcaacauuauaaauuaccugaacaaugaguccgcaacagcgaaggcugaauugucaagauaugaccugcagaaguuacucugcgauaaagccaagaccgacaacaauggaaacuacaaaugggugaucaggaagcccugggcuagcuuuacucaggauaccuaucuggcccuugagaauauuaucgucucuuucaaacaaaaccugcgggugauuaauaaggcuacaaaccgauuuuugcauuacaacgaagaggguaagaaaaucuucguuaagcagggcaaaggggacaauugggccauaagaaaguccaugcacaaagacaccguguuuggagaaguaaaccuccgcaggaucaagacugucgcacugaaugaggcuaugaagaacccgcagaguauuguggugaaagauuucaagcguaaacuacuggagcuuuggaaucucggcuuugacgccaagcggaucaaaaaguauuucgaagauaacagagagacauggagcgacauuaaucugucuaagaucgaagucuacuacuuuuccaaagauacgaaggacagguucuucgcgacccgcaaaccuuuggauacuucauuugaccgaaagaaaauagagaacaauauuacagauaccgguauccagaagauccuguuaagacaccucgaacugaaagacaacaauccagauauugccuucagucccgacgggaucgaugagaugaaccggaauauaauucaacuuaacaauggcaaguaucaucagccuaucauuaagaucaggugguacgagcaggcugacaaauuugcaguuggacagacaggcaacaaguucagcaaauuuguggaagccgcuaaggggacuaaucuguucuuugccguauaugagucgaacauauuggacaaaaagaccaacacgauuaucaagaaacgcaauuacgcaaccaucccccucaacguggcgauugaacgucaaaagcagggacugccagucgccccugaggaugagaauggcaacgaccccaucuucgugcuauccccaaaugaucugguuuaucuuccgacagacgaugaacucgcuaacgguauuauagcccagccucuggacagagggcggaucuacaaaauggugucuuguacuggaaaugagggccacuuuauucccgcaaggaucgcuaacccaaucuugcaaaccauugaauuagguagcaauaacaaggcccagaaagcauggacagaugagaugauaaaggaaaucugcaugcccauuaaggucgaccgccugggcaaugugcucgagucaaguuccucuuauaaaaaguga

SEQ ID NO: 3423 - RNA, 4530 nt, Artificial Sequence
  Cas9 variant
augaagagaauccugggccucgaccuugggaccaacagcauuggauggucccugauagagcacgauuucaaaaauaagcagggucagaucgaaggcuugggggugaggauuauccccaugucucaggagauuuuaggaaaauuugacgccggccagucaaucagucagacagcugaucggacuaaguaccgcgguguccgacgucuguaucaaagagacaaccuaaggcgggaacgccuccauagaguucugaaaauacuugauuuccugccuaagcacuacagcgaguccaucgacuuucaggauaagguggggcaguucaaaccaaagcaggaaguaaaauugaauuauaggaagaacgagaaaaauaagcaugaguuuguguucaugaacucuuuuauugaaauggucucggaguucaagaaugcacaaccggaacucuuuuacaacaaaggaaauggcgaggagacgaagauccccuaugacuggacccuguacuaucugcggaaaaaggcccucacacagcagauuacuaaagaagaguuagcguggcugauccuuaacuucaaucagaagcgcggcuacuaccaauugcgaggggaagauauagacgaggauaaaaacaagaaguauaugcagcugaaagugaauaaccuaauugacucaggagcuaagguuaaagguaaggugcucuacaaugucaucuuugauaacggcuggaaauaugaaaagcagauugugaacaaggacgagugggaggggagaaccaaagaauuuaucaucacaaccaagacucugaaaaauggaaacauuaagaggacauacaaagccguagacagcgagauagauugggcagccaucaaggcuaagaccgaacaagacauuaauaaagcaaacaagacgguuggcgaguauaucuacgaaagucuucuggauaauccuucccagaaaauacgggguaaguuggugaaaacuauugagcguaaguucuauaaggaggaauuugagaaacuccugucuaagcagaucgaauuacagccagagcuguucaacgaaagccucuacaaagccugcaucaaggagcuuuacccccgcaaugagaaccaccaauccaauaacaaaaagcagggguucgaauaucuguucaccgaggacauuaucuuuuaccagagaccuuugaaaucacagaagaguaauauuagcggaugucaauucgaacauaagauauauaaacagaagaacaaaaagacaggcaaacuagagcugaucaaggagccaauuaagacuaucucuaggucccacccccucuuucaggaguuccggaucuggcaguggcugcaaaaucuuaaaauuuacaacaaggagaaaauagaaaauggcaagcuggaggaugucaccacacaguugcucccuaacaacgaggcuuaugugacccuguuugacuucuuaaauacgaaaaaggaacuggagcagaagcaguuuaucgaauacuucgugaaaaagaaacuaauugauaagaaagagaaggaacacuuucgauggaacuucgucgaggacaagaaauauccauuuucagaaacucgcgcccaauuccucagcagacuggcgaagguuaaagggaucaagaauacagaggauuuccuuaacaaaaauacccaggugggaaguaaggagaacucuccguuuauuaaaaggaucgaacaguuguggcauauaaucuacuccguaagcgaccugaaggaguacgaaaaggcacucgagaaauucgccgaaaagcacaaucuggagaaagauucguuucuuaagaacuucaaaaaguuucccccuuucgugucugacuaugcuuccuacucaaagaaagccauuaguaagcuguugccaaucaugcggauggguaaauauuggagcgaguccgcaguccccacucaagugaaggaacgcucucucagcauuauggagagaguuaaagugcugccuuuaaaggaaggcuacucagacaaggaucuggcugaccuacucaguagggucuccgaugacgauaucccaaaacagcugauaaagagcuuuauuucuuucaaagacaagaauccccuuaaaggguugaacacauaucaggccaauuaccugguguauggacgucauucagagaccggcgauauccagcacuggaagacgccggaggacauugaucgguaccucaacaauuuuaagcaacacagucugcgaaacccuaucguagaacagguugugauggagaccuuaagagucgugagggacauaugggaacauuacgguaauaacgagaaagauuucuuuaaggaaauccacgucgagcuggggcgcgagaugaaaagccccgcgggcaagcgggaaaaacuuucccagagaaacacagagaaugaaaacacuaaucauaggauucgcgagguguugaaggaacucaugaacgacgccucuguugagggaggcgugcgagauuauucgccaagccagcaagagauccugaagcuauacgaagaggggauuuaucagaauccuaacaccaauuaccugaaaguagacgaagacgagauccucaagauacggaaaaagaacaaucccacacagaaagaaauucagcguuauaagcuguggcuugagcaaggauacaucuccccauauacugguaaaaucauucccuugaccaagcuguucacacacgaguaccagaucgaacauauuauaccucagucaagauacuaugauaacaguuuaggcaauaagaucauuugcgagucugaagucaacgaggacaaagauaauaagaccgcauacgaguaucucaaaguggaaaaggggagcaucguuuuuggacacaaacugcuuaaccuggacgaguacgaagcucacgugaauaaguauuucaagaaaaacaagacuaaauugaagaaccuccuguccgaggauauuccagaaggcuucaucaauaggcaacuaaacgacucacgcuacauaagcaaacuggucaagggucuccugucuaauaucgugcgggagaacggggagcaggaagccacguccaagaaucuuauuccgguaacaggcgugguuaccaguaaauugaagcaggauuggggacugaacgacaaauggaaugagaucauugcucccagauuuaagagguuaaacaaacucacuaauagcaacgauuucggcuuuugggacaaugauaucaacgccuuccgaauacaggucccugacucucugauuaagggguuuuccaagaaacgcaucgaucaucggcaccaugcacuugacgcccuggugguggcuuguaccucaagaaaucacacacacuaucuaagugcgcucaacgcagaaaauaagaacuacagccugagggacaaauuggucaucaagaaugagaacggagauuacaccaaaacuuuccaaauuccauggcaggguuuuacaauagaagccaagaacaaucuggagaaaacgguugugucguucaagaagaacuuacgugugaucaauaaaaccaacaauaaguuuugguccuauaaagacgagaacggcaaucucaaccuggggaaggauggaaaacccaagaagaaacuucgcaagcagacuaaaggcuacaauugggcuauucggaagccucugcauaaagaaacaguaucugguaucuauaacauuaaugccccaaagaacaagaucgcaaccagcgucagaacauugcucacugagauaaagaaugaaaagcaccuggccaaaaucaccgaccuaaggauucgagagacgauccugcccaaccaucuuaagcacuaccucaauaacaaaggggaagcuaacuucucagaggccuuuagucagggcggaauugaggaucugaauaagaagaucaccacauugaacgaaggcaaaaagcaucaaccgauauaucgggugaaaauuuucgagguuggguccaaguucucuaucagcgaagacgaaaauuccgcaaaaucaaagaaauacguggaggcggcuaagggaacuaaccuguuuuucgccaucuauuuagaugaagagaauaagaaacgcaacuacgaaaccauuccucucaaugaggucaucacacaccagaaacagguggcaggcuuuccaaaaagcgaaagacugaguguucagcccgacucucaaaaggguacuuuccuuuuuacccuguccccuaacgauuugguguacguacccaauaacgaggagcucgaaaauagggaccuguucaaccuagggaaucugaacgucgagcagauaagccggauuuauaaauuuacggauucgucagacaagacaugcaauuucaucccauuucaggugucuaaacuuauuuucaaccucaagaagaaagaacagaagaaacuggacguggauuuuaucauacaaaacgaguucggauugggcaguccucaguccaagaaucaaaagagcauugacgaugucaugaucaaagaaaaguguaucaaauuaaagauugaccgacuggguaacaucucuaaagccuga

SEQ ID NO: 3424 - RNA, 4530 nt, Artificial Sequence
  Cas9 variant
augaagaccauccugggccucgaccuugggacaaacagcgugggaugggccgucauuaauuccguuauaaaagagcaggcugaaagaaucuggauugagauggcagguucuaggaucauucccauggaugccgcggugcugggcgacuucgauaaggggaacucaaucagucaaacuagcgaacggacgcgcuugcgaggaguacguagauuaagggagcggcagcugcuacgcagagaaaggcuccacaaagugcugaauauacuuggcuuucugccuaaccauuacuuggaguauaucgacuucgagaagcacccagguaaauuucucuccgaugcugaaccgaagcugcccugggucaaggacgagcaggggaaauacaccuuccuguuucaggccgcauucgaugaaaugcucgccgacuuugcuauucaucaaccuucuuuagugucgggagauaagaaaaucccauaugacuggacaauuuacuaucugcggaagaaagcacuuacugagaugaucucaaaggaggaauuggccuggauacugcuaaauuucaaccagaagcgcggcuacuaucagcuccgaggcgaggaagaggaagauaaugcugggaaaagcguugaguuuuacgcccugaaggugcuuaccgucgaggcgacagacgaaaagaagggaagagaugugugguacaacguacaccuggagaaugguuggauuuauaggcggaguuccucuguucccuuggacugggaaggccagaucaaagaguucauugugaccacugaccucaacccugauagcacaccaaagcuggacaaauacggggaagucaagcguuccuuucgcgcacccaaggaggaugacuggauguuaaucaaaaagagaaccgaggccgauaucgcuaauacgcauaaaacugugggagccuauauuuacgacacccugcuccaaaagccucagcagaaaauaaucggcaaacuugugaagacagucgaaaggaaacuguaucgggaugaguugucacuaauucugcagaagcaaugcgcauuccacgcugaacuccaggaccgaacucuguacgcccgcuguguugaggcgcuuuauccaaacaaugaagugcagagaaggaacaucgccaaucgggauuuuguauaccuguugauggacgauguccucuucuaccaacgcccgcugaaaaccaagaaaaguuuaauagcaaacugccccuaugaggagaacgaauacguggacagagagacaggugaaauuaagaaggcuccucugaaauguaucgccaagagccacccacuauuccaggaguuuaggcucuggaauuuccugucuaacauccguauuuaucagaaagagaaggaaaucaaugggacccuucauuuggacguggauguuacggcugaguuucugaaaacugaagacgauuacguggcccucuucgacuggcugaacucccggaaggagauugaacagaagacauuucuuaaauaucccaaguucggacugaaaaaggagauaucaaauuaccgauggaacuaugucgaggauaaacaauacccuugcaaugaaaccagacacgcaaucuugagcaggcucgagaaggccaacguguguauugacuuucugaguaaugaaaaagagguagcuuuauggcauauccuguacucuguuuccgauaagcaggaaaucgagaaggcgcuacgcacuuucgcagccaaaaacggccucgacgagagcuuuguggaagcauucaagaaauuuccacccuucaagucggaguauggcgccuacucugcaaaagccauuaagaagcugcuuccguugaugcggugcgggaaauauugggaugucuccucaauagacgauacaaccaaggaaagaaucaaaaagauuguggcuggagaguacgacgaaaggaucgccgucaaagugcgcgauaagguuaugaaucugagugacauuagcuguuuuaagcgacucccucugugguuagcaugcuauaucguguacaaccggcacuccgaggacaaagaggcgguaaagugggaaucucccgcugauauagacgccuaucuggcuagcuucaaacagcacucacuucguaauccaaucgucgaacaggugauuacggaaaccuugagaguugugagggauaucuggaagcaagucggucgcauugacgagauccauauagagcucggccgggaaaugaaaaacccugccgauaagagaaagaggaugacagcucagauucuggagaaugaaaacgccaaccuacgaaucaaagcacugcucgcugaguucaugaaucccgaauacgagauugagaacgugcgcccauacagucccucccagcaggaaauccugcggauauaugaggacaugguacuucacgccgaagaucaauugccugaggaaaucgacgcgauucugaagaaauuuaauagcucuaaggugccaacuaaaucagaguucuuaagauacaagcucuggcuggagcagaaauauaggaguccguacaccggggaacuuaucccccugggaaaguuguuuacagccgcuuaugagauugaacauguuaucccucagagccguuacuucgaugacuccuuuucuaacaaggucauaugugagucggcagugaauaaacucaaggauaaccagcugggcuaugaguucauuaaaaaucaccauggucaaaagguggaggucggguuuggcaaaagcguugagaucuucuccguggacucauacgaacgcuuugugaaggagcaguacgccaagagugcuguaaaaaugaagaaaaugcuaauggaugacaucccagaacaguucauugagcggcaacugaacgacucuagauauaucagcaaggucauuaaaggacuccuguccaauauagugagggagaagaacgauucaggcgaauacgagcccgaagccguuagcaagaauaucguggucugcacugggucugugaccgaccgacuuaaacgggauuggggaaugaacgacguuuggaacuccauuguguauccucgcuuugagagauugaauagucugacagauacccagagcuucggucacugggaaaauaagucuggcaaaaagguauuucagacugaguuaccacucgaguaccagaaaggguucuccaagaagaggaucgaccaccggcaucacgcaauggaugcgauugucaucgccugugcuacgcgaaaccaugugaacuaucugucaaaugaaagugccagcagaaacgcaaaaauaucgcgcuacgaccuucaaaggcugcuaugcgauaagucccguacagacgauaauggaaacuauaaaugggugaucaagaaacccugggacaccuucacucaggacgcucgggagguccucucuaagauuguugugagccugaagcagaauuugagaaucauuaacaaaaccacaaauguauacaggcaccuggaugccaccggcaaccgcguguacgaaaagcagaaaacuggugacucaugggcaauccgaaagccgaugcacaaagauacagucuuuggggccgugaauuuaagaaagguuaaagugguccggcucaguguggcucuggacgcgccuacgaugauaguugauaagagggugaagaacaaagucuucgagcuucuguccuauaaguacgacaaaaagcgcauugaaaaauauuuuaaggagaaugccguauuguggaaggagcucgaucuggcacguguggcuguuuacuauuucaccgaagccacuacagagccccuaguggccgucagaaaaccacuggacucuaccuuuaacgaaaagaaaaucaaggagagcgugacagauacuggcauccagaaaauucuucucaaucaucugugcaccaaggaaggaaagccugacuuggcuuucuccgcagagggcauagaggaaaugaaccggaaucuguuacaacucaacaacgggaaaaggcaccagcccaucuacaagguacgcguguaugagccacgaggaaauaaauuuucagucgguguucugggcaacaaggggacgaaauggguggaagccgcgaagggaaccaaucuuuucuuugcuauuuacaucacagaggauggcaagagaacuuacgagaccauuccucugaacauggugaucgaacgggagaaacaggguuuggcccccgucccagacaagaaugaaaaaggggauaagcuccuguucuggcuaagcccgaacgaccugguguaucuuccuacagaggaggaacucgaguuuggcaggauaaaugaacccaucgaccgcggaagaauuuacaaaaugguuaguucuuccggcaaccaauguuucuucaucccacagagcauuucgaaugcaaucauacccacuaaggagcugggggccaacaauaaagcugaaaggucaugggauggagcaaugauuaagaacaucugcaucccuguaaagguggaccgguugggccguauuaucgaggucaaauaucgcauaaaugaauga

SEQ ID NO: 3425 - RNA, 4530 nt, Artificial Sequence
  Cas9 variant
augaagaccauccugggccucgaccuugggacaaacagcgugggaugggccgucauuaauuccguuauaaaagagcaggcugaaagaaucuggauugagauggcagguucuaggaucauucccauggaugccgcggugcugggcgacuucgauaaggggaacucaaucagucaaacuagcgaacggacgcgcuugcgaggagcucguagauuaagggagcggcagcugcuacgcagagaaaggcuccacaaaguacugaauauacuuggcuuucugccuaaccauuacuuggaguauaucgacuucgagaagcacccagguaaauuucucgccgaugcagaaccgaagcuggccugggugaaggacgagcaggggaaauacaccuuccuguuucaggcugcauucgaugaaaugcucgccgacuuugcuauucaucaacccuccuuagucucuggagauaagaaaaucccuuaugacuggacaauuuacuaucugcggaagaaagcccuuacugagaugaucucgaaggaggaauuggcguggauacugcuaaauuucaaccagaagcgcggcuacuaucagcuccgaggcgaggaagaggaagauaaugcagggaaaucaguggaguuuuacgcccugaagguucuuaccguggaggcuacagacgaaaagaagggaagagaugucugguacaacgugcaccuggagaaugguuggauuuauaggcggagcaguuccguaccauuggacugggaaggccagguuaaagaguucaucgugaccacugaccucaaccccgaugggacaccuaagcuggacaaauacggagaagucaagcguucuuuucgcgccccaaaggaggaugacuggauguuaauuaaaaagagaaccgaggcagauaucgcuaauacgcauaaaacugugggcgccuauaucuacgacacccugcuccaaaagccccagcagaaaauuauagguaaacuugugaagacagucgaaaggaaacuguaucgggaugaguugagccuaauccugcagaagcaaugcgcguuccacgccgaacuccaggaccgagcacuguacgcucgcuguguugaggcccuuuauccuuccaacgaagugagaaggaaaaauauugcuaaccgggauuuuguauaccuguugauggacgauauccucuucuaccagcgcccacugaagacuaaaaagucauuaauagccaauugcccguaugaggagaacgaauacguggacagagagaccggggaaauuaagaaaacaccccugaaguguaucgcaaaaagucacccucuauuccaagaguuuaggcucuggaacuuccugagcaauauccguauuuaucagaaggagaaagaaaucaacggaacccuucauuuggacgucgaugugacggccgaguuucugaagacugaagacgauuacguugcucucuucgacuggcuuaauucucggaaggagauugaacagaaaacauuucuuaaguauccaaaauucggccugaagaaagagauauccaacuaccgauggaauuauguggaggauaagcaguaccccugcaacgaaaccagacacgcgaucuugucaagccucgagaaagcaaaugucuguauugacuuucugaguaacgaaaaggagguggccuuauggcauauccuguacucuguauccgauaagcaagaaaucgagaaagcucuaaggacuuucgccgcaaagaauggccucgacgagagcuuuguugaagccuucaaaaaguuuccuccauucaaaucggaguauggggcuuacucugccaaggcaauuaagaaaaugcugccccuuaugcgcugcggaaaguauugggauguguccucaauagacgauacaaccaaagaacggaucaagaaaauugucacgggugaguacgacgaaagaaucagugugaaggucagggauaaggugaugaacuugagcgacauuuccuguuuucgccgacugccgcucuggcuggcgugcuauaucguuuacaaucggcacucugaggacaaagaggcugugaagugggaaagcccugccgauauagacgcauauuuagccucauucaaacagcacagucugcguaaccccaucguagagcaggucauuaccgaaacacuuagagugguuagggauaucuggaaacaggugggccgcauugacgagauccauauagaguuggggcgggaaaugaaaaauccagcugauaagagaaagaggaugacugcccaaauucucgagaacgaaaaugcaaaccugcgaaucaaagcucuacuggccgaguucaugaacccugaauacgagauugagaauguccgccccuacuccccaagccagcaggaaauccuccggauauaugaggacaccgugcugcacgcggaagaucagcuucccgaggaaaucgacgccauuuugaagaaauuuaacucuucaaagguaccuacaaaaagugaguuccugagauacaaguuauggcucgagcaaaaauauaggagcccauacacuggagaacugaucccgcuuggcaagcuguuuaccgcugcauaugagauugaacaugugaucccccagucccguuacuucgaugacucuuuuucgaauaagguuauaugugagagcgccgucaacaaauugaaggauaaucagcucgguuaugaguucauuaaaaaccaccaugggcagaagguggaagugggcuuuggaaaauccgucgagaucuucucaguugacaguuacgaacgcuuugugaaggagcaauacgcuaagucugccgugaaaaugaagaaacugcuaauggaugacaucccugaacaguucauugagcggcagcugaaugacagcagauauaucuccaagguaauuaaaggccuccugucaaacauagucagggagaagaaugauagcggggaauacgagccagaagcagugucuaagaacaucguugugugcacaggauccgucaccgaccgacuuaaacgggauugggguaugaaugacguguggaacaguauuguuuauccccgcuuugagagauugaauagccugacugauacgcaaucuuucggccacugggaaaacaaguccgggaaaaagguguuucagacagaguuaccucucgaguaccagaaaggauucucaaagaagaggaucgaccaccggcaucacgcgauggaugccauuguaaucgcuugugccacccgaaaucaugucaacuaucugaguaacgaaagcgcaucgagaaaugcuaaaauaucccgcuacgaccuucagaggcugcuaugcgauaagaaccguacugacgauaauggcaacuauaaaugggugaucaagaaaccaugggacaccuucacacaagacgcccgggaggugcucucuaagauugucguuagccugaagcagaauuugagaaucauuaacaaaaccacuaauguguacaggcaccuggaugcaacagguaaccgcguauacgaaaagcagaaaacgggggacucaugggccauccgaaagcccaugcacaaagauaccguguuuggcgcugucaauuuaagaaaggugaaaguugugcggcucagugucgcgcuggacacuccggccaugauaguggauaagaggguuaagaacaaaguguucgagcuucuguccuauaaguacgacaaaaagcgcauugaaaaauauuuuaaggagaaugcauucuuguggaaggagcucgaucuggcuaaagucgccguauacuauuuuacagaagccaccacagagccucuaguggcuguucguaagccacuggacucuacuuucaacgaaaagaagaucaaagagagcgugaccgauacgggaauccagaagauucuucucaaucaucugugcaccaaggaaggcaaacccgacuuggcauuuuccgccgaggggauagaggaaaugaacagaaaucuguuacaacucaacaacggaaagucacaccagccuaucuacaaaguccggguguaugagcccagggguaauaaguucagcguaggcgugcuggggaacaaaggaacaaagugggucgaagcggcuaagggcacuaaucuguuuuucgccauuuacaucaccgaggaugguaaacgcacauacgagacuauuccacugaacguugugaucgaacgagagaagcagggguuggugccuguccccgacagaaauaaaaagggcgauaaacuccuguuuuggcuaaguccaaacgaccugguguaucuuccgaccgaagaggaacgggaguucggaaggauaaaugagccuaucgaccgcggcagaauuuacaagaugguuucuuguacggggaacgaaggacauuucauccccgcaaauguagccaacccaauugugcccgucaucgagcucggcuccaauaacaaagcucagagggcauggacaaaugaaaugauaaaggauauuugcaucccuaucaagguggaccggcugggucacauuaucgagguuaaauaucguauagaugaauga

SEQ ID NO: 3426 - RNA, 4530 nt, Artificial Sequence
  Cas9 variant
augaagaaaauccugggccucgaccuugggaccaacagcgugggaugggccgucauuaauuccguugugaacgaugaggguaaggaacagcugguaaauauaucuucaugcggcaguagaaucauucccauggacgcugcaacauugggggauuucgacaaaggaaacagcaaguccccuguggccgagaggacucgguuacgcggcguccgacgucugcuagaaagaucucuccugaggcgggagcgccuucacagagugcugucgguuaugggguuuuugccagaacauuacgcggcucaacucgauagguaugggaaauuccugccggagacggagcccaagcuggccugguacaaggacgaaaccggaaaauaucgguuucucuuccaggauucauuuaaugagauguuagaagacuuccacgagcaucacccugagcugguggcagaaggcaagaaaauccauuacgauuggacaauuuauuaccuucgcaagaaagccuugagccagaagaucacuaaggaggaacuggcuuggauacuacucaacuuuaaucagaaacgaggcuauuaccaacugagaggggaggaggaacaggaggacaacaagaaaagugucgaauacuaugcacuuaaggugguagccguugaggauuccggagacaggaaagguaaggauaucugguacaaugugaaacuggaaaacggcugggucuaucggcgugcuucuggggugccauuggacugggugggaaaggucaaggaguucauuguuaccacagaccucgaugaaaaaggcaaucccaagaaagacaaggaugguaacgugaaacgcagcuuuagagccccuaaggaggacgauugggggcuguuaaagaccaggacucaggcgcagaucgacgaguccggacaaacaguaggcaccuacauuuaugaaucacugcuccggaugccagaucagaaaauccgaggcaaacuugugcgcacgauagagagaaaauacuauaaggacgaacugaggaaaauuuugaucaagcagagugaguuccacacugcacuacaggaucacaaucugcuccuggccuguauugaggaacuuuaccccaacaaugaggcucaucggcgccuguugagcaccucugacuuuacauacuuccucgucgaagauauccuguuuuaucaaagaccuuuaaagucccagaaagggcagaucgacgacugcccauacgagucacacguguauagggauaagaaagacggaagccugcaacauguuccgcuaaagugugugaguaaaucucacccccucuuccaggaguuccgucuguggcacuuucuuuccuucuugcggauuuaccagcgagaaagaaugauagaugguagccugaagcucgacgucgaugugacuaacgaguuucugcagaacgaagacgauuauguaaaacuuuucgacuggcugaaugagaggaaggaaaucgaucaaaagaccauuuuggccuacaaaccuuuuggccucaagaaaaacgagcagucgaaguaucgcuggaauuacguugaagacaaaucuuacccaugcaacuccacacgggcagauaugaucuucagacugucaaaggcuggggugcccgaggaguuuuuaaccagggaaaaggaggaagcccuguggcauauacuauauaguauuagcgacaaaaaggagcucacgaaagcgcugggaacuuucgccgaaaagaauggccuuaacgagacauuugucgagaucuucuccaaaaugccuccauuugaaucugauuacgcagcuuauagcuugaaggccauccgcaagcugcucgcucugaugcgaauggguaaauacugggacgagcaggccauugacgaacacacccggucacguaucgagaagauuuuaacuggggaauaugaugagacaauaagaaccagggugcgcgagaaagcaaugcaucugacggacaucaguuccuuccggggccuucccuuguggcucgccuguuacgucguguaugauagacacagcgaagcuaaggagcugguuaaaugggaaaccccggacgauauugaccauuuucuaaggaaguucaagcagcacucucugcgaaauccuaucguggagcaaaucauuauggagacacuccgcacuguacgggauauauggaaacaggaaggaaagaucgacgagauucacgucgaacugggcagagagaugaaaaaccccgcgaaggaaagggcacguaucaccgcccaggugcuugagaaugagaacacaaauuugcgcauuaaagcucuguuagccgaguucaugaacccagaauuugaaaucgagaauguucggccuuacucacccgcacagcaagaaauacucagaaucuacgaggagggggugcugaguggagucgccgaaaaggaucuuccagacgauauugcuagcauccugaagaaauucagggagaacgacgugaagaaacgacccacuaccuccgaaguauugcgguauaagcucuggcuggagcagcgcuacagaucuccuuauacagguaggauuaucccacuaggcaaacuguuuaccccggccuacgaaauagagcaugugauuccccagucgcgguauuucgaugacagcuuuacuaauaagguuaucugcgaguccgcagucaacaaacucaaggacaacugucugggguacgaguucgugaagaaacacucaggagaaaagguggaacuuggcaauggugagacggcgacaauuuuuagugucgaggaauaugagcgauucguuaaagauucuuacuuuaacaauagcaagaaaaucaagaaguugcuguuagaagacauaccugauaacuucaucgagagacagcucaaugacucccgcuacauuucaaaagugguaaagagccugcuuucuaacaucguaugcgaagagggggagcaagaaggcauguccaaaaaugucauuguguguaccggaggcguuacugauaggcugaagaaagacuggggugugcaggaugucuggaaccguaucauacuaccacgguuucucagacugaauaagaugaccgacaggacagauuucaccgcugugaguacuaacggacauuugcugcccgccguuccuuuacaccuccagaaggguuuuaauaaaaagcgcauugaccaccgacaucacgcaauggaugccaucgugaucgcuugcgccggcagaaacauuguaaauuaucugaacaaugcaagcgcucggaaagggucugagaucuccagguacgaccuucaacaucuguugugugacaaggucaaaacagaugccaacggaaacuauaaguggauucuccgcaagccaugggaaacguucacccaggaccuguacgcggcccuaacuaauauaguggugucauucaaacagaaccugcgugucaucaauagaacaaccaaccacuaucagcauuacaaugaggauggcgaaaagaaaaugauuccccaaacaaagggugaccggcuugcuaucaggaaaccgaugcacaaggauacuguuuauggggaggugaaccuccgcaaggagaaaacccugccuuugaaggacguagugaaaaauccaagugcagucguggauaagagccugaaaaacaaguuauacgaacuccugaaaucgcaguacgaccuuaaggccauuacgaaguauuuugagacccaccaggauguuugggcugacgugaaucugaaaaagaucaaagucuacuauuucacaaaggaaacuaacgagcgauuuuucgccaccagaaaauccuuggauucuagcuuuucacagaagaagauagaagaggaggugacagacacuggcauccaaaagauucuccugcggcaucuacagcagaauggaaacaaucccgauaucgcauucaguccugacggcguugaaaggaugaaccagaauaugaccauucugaacgacgggaaguggcaccaacccaucuacaaagugcgcacguaugagaaggcggauaaauuugccgucggagaaaagggcaacaaggugaaaaaguucguggaggcugccaaagguacaaaucucuuuuucgcaguuuacgaguccauacaggaagacgaggcuaccgggaaacaggugagaaagaggacuuuugccacaauuccacuuaacgaagucaucaagcggaagaaacaaggacugccugcagcccccgaggauucuaagggcaauuugccaaucuucguguuaagcccgaacgaccugguauaucucccuaccgaagaggagcguaauuccgguaaaauuauacagccccuggaucgcgaacgaaucuacaagauggugucaugcacugagggcgaaugccauuguauuccagaguacgucgcuaaccccauccuucagaccauugaacuggggagcaauaacaaagcgcagagagccuggaguggagagaugaucaaggagauaugcguuccugugaaaguggacagguugggcaaugucucucuaaucaagauuuga

SEQ ID NO: 3427 - RNA, 4530 nt, Artificial Sequence
  Cas9 variant
augaagaccauccugggccucgaccuugggacaaacagcgugggaugggccgucauuaauuccguuauaaaagagcaggcugaaagaaucuggauugagacugcagguucuaggaucauucccauggaugccgcggugcugggcgacuucgauaaggggaacucaaucagucaaacgagcgaacggacccgcuugcgaggagcucguagauuaagggagcggcagcugcuacgcagagaaaggcuccacaaaguacugaauauacuuggcuuucugccuaaccauuacuuggaguauaucgacuucgagaagcacccagguaaauuucucgccgaugcagaaccgaagcuggccugggugaaggacgagcaggggaaauacacauuccuguuucaggcugcauucgaugaaaugcucgccgacuuugcuauucaucaacccuccuuagucucuggagauaagaaaaucccuuaugacuggacuauuuacuaucugcggaagaaagcccuuaccgagaugaucucgaaggaggaauuggcguggauacugcuaaauuucaaccagaagcgcggcuacuaucagcuccgaggcgaggaagaggaagauaaugcagggaaaucaguggaguuuuacgcccugaagguucuuacaguggaggcuaccgacgaaaagaagggaagagaugucugguacaacgugcaccuggagaaugguuggauuuauaggcggagcaguuccguaccauuggacugggaaggccagguuaaagaguucaucgugacuacagaccucaaccccgaugggaccccuaagcuggacaaauacggagaagucaagcguucuuuucgcgccccaaaggaggaugacuggauguuaauuaaaaagagaacggaggcagauaucgcuaauacucauaaaaccgugggcgccuauaucuacgacacacugcuccaaaagccccagcagaaaauuauagguaaacuugugaagacugucgaaaggaaacuguaucgggaugaguugagccuaauccugcagaagcaaugcgcguuccacgccgaacuccaggaccgagcacuguacgcucgcuguguugaggcccuuuauccuuccaacgaagugagaaggaaaaauauugcuaaccgggauuuuguauaccuguugauggacgauauccucuucuaccagcgcccacugaagaccaaaaagucauuaauagccaauugcccguaugaggagaacgaauacguggacagagagacaggggaaauuaagaaagcaccccugaaguguaucgccaaaagucacccucuauuccaagaguuuaggcucuggaacuuccugagcaauauccguauuuaucagaaggagaaagaaaucaacggaacccuucauuuggacgucgaugugacggcugaguuucugaagacugaagacgauuacguugcucucuucgacuggcugaauagccggaaggagauugaacagaaaacauuucuuaaguauccaaaauucggccugaagaaagagauauccaacuaccgauggaauuauguggaggauaagcaguaccccugcaacgaaaccagacacgcaaucuugucaagccucgagaaagccaaugucuguauugacuuucugaguaacgaaaaggagguggcuuuauggcauauccuguacucuguauccgauaagcaagaaaucgagaaagcccuaaggacuuucgcagccaagaauggccucgacgagagcuuuguugaagcguucaaaaaguuuccuccauucaaaucggaguauggggccuacucugcaaaggcgauuaagaaaaugcugccccuuaugcgcugcggaaaguauugggauguguccucaauagacgauacaaccaaagaacggaucaagaaaauugucacgggugaguacgacgaaagaaucgcugugaaggucagggauaaggugaugaacuugagugacauuagcuguuuucgccgacugccgcucuggcuggccugcuauaucguuuacaaucggcacuccgaggacaaagaggcagugaagugggaaucuccugccgauauagacgcuuauuuagccagcuucaaacagcacucacugcguaaccccaucguagagcaggucauuaccgaaacacuuagagugguuagggauaucuggaaacaggugggccgcauugacgagauccauauagaguuggggcgggaaaugaaaaauccagcagauaagagaaagaggaugacugcucaaauucucgagaacgaaaaugccaaccugcgaaucaaagcgcuacuggccgaguucaugaacccugaauacgagauugagaauguccgccccuacaguccaucccagcaggaaauccuccggauauaugaggacaccgugcugcacgcugaagaucagcuucccgaggaaaucgacgcaauuuugaagaaauuuaacagcucuaagguaccuacaaaaucagaguuccugagauacaaguuauggcucgagcaaaaauauaggaguccauacacuggagaacugaucccgcuuggcaagcuguuuaccgccgcuuaugagauugaacaugugaucccccagagccguuacuucgaugacuccuuuucuaauaagguuauaugugagucggccgucaacaaauugaaggauaaucagcucgguuaugaguucauuaaaaaccaccaugggcagaagguggaagugggcuuuggaaaaagcgucgagaucuucuccguugacucauacgaacgcuuugugaaggagcaauacgcaaagagugcggugaaaaugaagaaacugcuaauggaugacaucccugaacaguucauugagcggcagcugaaugacucuagauauaucagcaagguaauuaaaggccuccuguccaacauagucagggagaagaaugauucaggggaauacgagccagaagccgugagcaagaacaucguugugugcacaggaucugucaccgaccgacuuaaacgggauugggguaugaaugacguguggaacuccauuguuuauccccgcuuugagagauugaauagucugacugauacgcaaucuuucggccacugggaaaacaagucugggaaaaagguguuucagacagaguuaccucucgaguaccagaaaggauucuccaagaagaggaucgaccaccggcaucacgcuauggaugccauuguaaucgcaugugcuacccgaaaucaugucaacuaucugucaaacgaaagugccagcagaaaugcaaaaauaucgcgcuacgaccuucagaggcugcuaugcgauaagaaccguacugacgauaauggcaacuauaaaugggugaucaagaaaccaugggacaccuucacacaagacgcccgggaggugcucuccaagauugucguuucucugaagcagaauuugagaaucauuaacaaaaccacuaauguguacaggcacuuugaugcuacaguaaaccgcguguacgaaaagcagaaaacgggugacagcugggcgauccgaaagcccaugcacaaagauaccgucuucggggccgugaaucugagaaagguuaaagugguccgguuaucaguggcacucgacacuccggcuaugauaguugauaagagggugaagaacaaagucuuugagcugcuuaguuauaaguacgacaaaaagcgcauugaaaaauauuucaaggagaaugccuuucuguggaaggaguuggaucucgccaaaguagcuguguacuauuucacagaagcaaccacagagccucugguugccgugcguaagccacuagacuccacuuuuaacgaaaagaagaucaaagagucugucaccgauacgggcauccagaagauucugcuuaaucaucucugcaccaaggaaggaaaacccgaccuggcguucagcgcugagggcauagaggaaaugaacagaaauuugcugcaauuaaacaacgggaagucccaccagccuaucuacaaagugcggguauaugagcccaggggaaauaaguuuucaguggguguccucggcaacaaagggacaaaguggguugaagccgcaaagggaacuaaucuguucuuugccauuuacaucaccgaggauggcaaacgcacauacgagacuauuccacuuaacguggugaucgaacgagagaagcagggucuggucccugugcccgacagaaaugaaaaaggggauaagcucuuguucuggcugagcccaaacgaccuaguuuaucugccgaccgaggaggaacgggaguucggcaggauaaaugaaccuaucgaccgcggaagaauuuacaaaaugguaaguuguacgggcaacgaggggcauuuuauccccgcuaauguggcaaacccaauuguccccgugaucgaacuuggaucuaauaacaaggcccagagggcguggacaaaugagaugauaaaagauauuugcaucccuaucaagguugaccggcucggccacauuaucgaagugaaguaucguauagaugaguga

SEQ ID NO: 3428 - RNA, 4530 nt, Artificial Sequence
  Cas9 variant
augaagaaaacccugggccucgaccuugggacaaacagcaucggaugggccgugauuaauuccaacauagauucugaggguaaggaaaaacuggucggcaucucaaguugcgggagcagaauuauccccauggacgcuacuacguugggagauuucggcaaggguaauaccaaauccccuguugcagagaggacacgguuacgcgggauucgacgucugcuagaaagaucucuccugaggcgggagcgccuucacagagugcugucgguaaugggauuuuugccagaacauuacgccucacagcucgacagguauggcaaguuccugccggagacugagcccaagcuggcgugguacaaagaugacagcggccgguaucaauuucucuuccagaagaguuuucacgaaauguuagaggauuuccgccagcaucagccugaacugguggcuggggagaaaaagaucccauacgacuggaccauauauuaccuucgaaagaaggccuugucccaagagaucacaaaggaagaacuggcauggauucuacucaacuuuaaucagaaaagaggauauuaccagcugaggggugaagaggaacaggaggagaacaauaagucugucgaauaccacgcccuuaaagugguuagcguggaggauuccggcgaacggaaggggaaagacaucugguauaacgucacccuggagaauggauggguguaccgucgcgcuucaaacauucccuuggauuggacuggcaagguaaaagaauuuguugugacaaccgagcucgacgaugcagguaauccuaagaaggacaaagaggggaacgucaagagaaguuuuagggccccaaaagaagacgauuggggacuguuaaagacgcggacucaagcucagaucgacgagagcggcaaaaccgugggcacauauauauacgaaucucugcucuguaugcccaaucagaagauucgagggaaacuugugcgcacuaucgagagaaaauauuacaaggaugaacugaggcagauuuuggucaaacaauccgaguuccaugccgcgcuacaggaccacaaccugcuccugucaugcaucgaggaacuuuauccuaauaacgaggcacaccggcgccuguugagcgccaguucuuuuaucuacuuccucauugaagauauacuguuuuaccagagaccauuaaagucccaaaaaggacugaucgacaacuguccguaugagagccauauuuacaaggauaagaaagacgguucgcuacaccauguuccccucaagugcgugucuaaaucccacccucuguuccaggaguucaggcuuuggcaguuuuugucaaaucugcguaucuaucagcgggaacgaaugauggauggcagucucaagcuggacguagaugugaccagagaguuccuuccaagcgaagaggacuacgucaaacuguuugacugguugaacgaaaggaaggagauaucccaaaaguuccuccuggcuuauaaacccuuuggguuaaagaaaaaugagcaggccaacuaccgcuggaauuauguggaagauaagucuuacccuuguaacgagacacgggcagaaauuaaaagcagacugucaaaggcuggaguuccagaggaauuucuaaccgaggagaaagaagaggcccucuggcacauccuguacaguaucuccgacaagaaggaacuuacgaaagcguugggcacuuucgccgcaaagaauugccugaacgagagcuucguggaagucuuugcuaaaauucccccguucgagucuaauuaugccgcuuacucacucaaggccaucaggaaacuguuagcacugaugcgcauggguaaguauuggaacgagcaggccauugaucgacagacacgggaccguauagaaaagauccuuaccggggaguacgaugaaacuauuagaaguagggugcgcgagaaagcuauguugcucacagacaucagcuccuuucggggccugccucuauggcuggcguguuauaucguauacgauagacauucugagucgaaggaacucguuaaaugggagacccccgcagacauugaucacuuccugagcaaguuuaaacaaaauucccuuaggaacccaauaguggaacaggucaucacggagucauugcgaaccgugcgcgacauuuggaagcaggaaggaaagaucgaugagauucaugucgagcugggccgggaaaugaaaaauccugccaaggagagagcuaggaucacagcccaggugcaagaaaacgagaauacuaacuuacguauaaaagcacuccuggccgaguucaugaaccccgaguucgagaucgaaaauguucacccauauagucccgggcagcaggagauucuucgcaucuacgaagacggagugcugucugguauugcugagaaggauuugccugacgacaucaccgccauacucaaaaaguuucgggaaaacgauguaaagaaaagaccaacaacuagcgagguccugagguacaagcuauggcuggagcagcgauaucgguccccguacaccggccgcgugauuccccucgggaaacuguucacgccugcauaugaaaucgagcauguuauuccacaaucaagauacuuugacgauagcaucucuaauaaggugauaugcgaauccgcggucaacaaacuuaaggacaauuguuugggauaugaguucaucaaaaagcacaguggcgagaugguggaacuggguaacggggagaccguacccguguuuagcguugaagaguacgaaagguucgucaaggagucuuauuuuggcaauuccaaaaagaugaaaaaguuacuccuggaggauauuccugacucauucaucgaacggcagcuuaacgauagucgauacauuagcagaguggugacuucgcugcuauccaaucucgucugcgaggaaggagagcaggacggccugucuaaaaacguuaucguguguacagggggaauaacagaucgcuugaagaaggacuggggugugcaagaaguauggaauaggauuauccugccacguuucuuacggcucaacgagaucaccggcagaacugauuucaccagcacaucagucaaugggcaucugcuucccgcucugccguuguaccuccagaaaggauuuaacaagaaaaggauugaccaccgccaccaugccauggaugcaaucgugauugccugcgcuaaucgaaacauaguuaacuaucugaauaacaguuccgccagaaagaacucugagaucagccgguacgaccuacagaggcugcuuugcgaaaaagugaagaccgacgcaaauggcaauuauaaguggauucuccgcaaaccuugggagacuuucacacaggaugucuacgcugcccugacgaacaucgugguuuccuuuaagcaaaauuugcgugugauuaacagaaccacuaauuauuaccagcacuauaacgaagcgggugagaaacggaugaucccacagacaaagggggacaggugggccauacgcaaacccaugcacaaggauaccguauacggcgaagucaaucugcgaaaggagaaaacauuaccucucagagacguggugaagaaccccucaaucgucguugauaaaagccugaagaauaaacuuuacgagcuguugaagagucaguaugaccucaaggcuauugcaaaauacuucgaaacucaucaagaugugugggccgacguaaaccugaagaaaaucaagguguauuacuucaccaaagagacgaaugaacgguuuuucgcuaccaggaagucucuagauccauccuuugaccagaaaaagauugaggaggaagucacagauacuggagugcagaagauccugcuucaccaucuccagcaaaacaacaaugacccugacauggccuucagccccgauggcauagaccgcaugaaccagaauaugaccauucugaacgaugggaaauggcaccagccaaucuauaagguuagaacauacgagaaagcagacaaguuugcggugggagaaucgggcaauaaagccaagaaguucgucgaggcugccaaagguacuaacuuguuuuucgcaguguaugaaucaguucaagaggaugaggcuaucgggaaacagguguguaagaggaccuuugccacgauuccguuaaaugaagucauaaagcggaaaaagcagggacugccugcagcccccgaggaccucaacggcaaucugccaaaguucguacuuucucccaacgaucugguguacuugccuacagaagaggaacguaauaguucccgcaucauucagccacuagaccgagagagaaucuacaaaaugguuagcucuagcgguucccaaugcuuuuucauuaagguguucgucgcuaacucaaucugggauaaaaaugaguauaguagccugaacaagauggaaagggcgauaaccaaugagaugaucaaagaaauuugugugcccaucaagauugaccggcucggcaacguaucucugauccagauauga

SEQ ID NO: 3429 - RNA, 4533 nt, Artificial Sequence
  Cas9 variant
augaagagaauccugggccucgaccuugggaccaacagcauuggaugggcccugguggauuccgaggaacagaggauauuggguaugggcucucggaucauucccauggaccaaggggucuuagauacauucucaggaggcaauccuguugagacucagacggcugcacgcaccguguaccgagguacacguagacugagggaacgggcccuacuccgcagagagaggcugauccggguacuuaacaugaugaaauuucugccagaacacuaugcgagucagauugacuucgagaagcgcuuggggcaguuuuucgaugagaaagaaccgaagcucgcuuggaaacaaaaugacgagggacgauuugaauuuaucuuucagcagagcuucaacgagaugauagaggaauuuaagaauaagggcguggucagagaggauaaaaagauccccuacgacuggacuauuuauuaccugaggaaaaaggcccugucccaggaaaucgagaaagaagaacucgcauggauuuuacugaacuucaaucaaaagcggggcuauuaccagcuucguggggaggaagaggaagagaacccuaauaaguugguggaauauuacucucugaaaaucguugaugugauagccgacgagaagccaaacucgaaaucagauauuugguacagccuacaucucgagaauggauggaucuaucgcagaaguuccaagauuccccuguuugguuggaaagacaagaccagggauuucaucgucacaaccgaccuuaacgacgauggcacugugaaaaaggacaaggaagggaucgagaaacggucuuuucgagcuccuagcgaaaaugauuggguacuguugaagaaaaagacagaguccgacauugaaaaaucacacaagaccguuggagcauacguguaugagacgcuccugcagaacccaaugcagaagguccgcggcaaauuagugagaacuauagagaggaaguucuacaaagaugaacugaagcaaauccucgagaaacagcgggaguuccaucccgagcuucgcgacgaggaucuguauaaugacugcgugagagaauuguacaggaguaacgagaccuaucaguuuauucuaagcaagcgugauuucguccaccuguuucucgacgauauccuguucuaccaacggccucuucgaucucagaaguccgccauaggugacuguauucuggaauuuaaaacauacaaggacaaagaugggaacaauaucaaggaguauuugaaaguuaucucaaagagcaacccacucuaccaggaguucagaauuuggcaguggcuguauaauuuaaagaucuacaggaaagaggacgaugaggacgugacucugcaauuuauugcuaacauagaagauaaggagcagcuauucgacuuucucaguaaucgcaaaucuaucgaacagaagccgcugcuugaguauuugauuaaagccaagggacugaaaaagcagguaaagaccgaagcguaccgguggaacuauguggaggauaaaaucuaccccugcuccgagacaaagaccaugaucagcacgagacucgcaaaagucgaaaauauuccugacaacuucuuuacuaaggagauagaacaaaaacuguggcauaucauuuacucggugacagauaagaaugaguucgaaaaggcccuuaggaccuuugcuaaaaaguaugaccuggauaucgccucuuucguugacaacuucaaaaagauuccacccuuuaaaaaugaguacggcuccuucucagagaaggcaaucaagaaauugcucccucugaugcgcuuaggcaaguauuggaaauggaacgauauagacaauaacacucagaaucgaaucaguaagauuaucacaggggaauacgacgaggaaauuaaagauaucgugcgggaaaagagcauagcucugaccaacgagaacgacuuucagggacuacagcucuggcuggcccaauaucuugucuacggucgucacuccgaagcggauauugccggcaaguggcacucuguggcagacuuggagaaauaucugaaugaguucaagcagcauagccucagaaacccaaucguagaacagauuaucacggaaacccugaggguugugcgcgauauauggcggaaauacgggcagggagcugagaauuucuucucagagauccacgucgaauuaggcagagacaugaagaacacagccgaugagaggaaaaagauugugaaugucgugacugaaaacgagaauaccaaccugcgaaucaaagcucuuuugauggaacucaagaauaacagugacgguaagcuggagguugagaaugugcgccccuacuccccgacacaacaggauauucuaaaaaucuaugaagaguacgccauaagcacugggcuggacaacgaaaaggaugagaaaguaaaggaagacauuaaaaagaucucucgggucgcacagccuaccacaaccgagcuccaaagauauaagcuguggcuugagcagaaauacuguucacccuauacuggcaaggugaucccauugggaaaacuguuuacggaagaguaccagauugaacauaucauuccuaagaguagguauuacgaugacagcuucuccaauaaaguuauaugcgaggccgcugugaacaaguuaaaggacaaaugucucggccuggaguuuaucaagaauuaccacgggcagauugucgaaacaggauucggucaaaaagugaccaucuuugaugaggaagcguaucagaacuucguaaagcagcacuacgcauauaaccauucuaaacguacuaaacuucuguuggaggaaauucccgagaagaugaucgagcgccagaugaaugacacccgguacauaucgaaguuugugcucccacugcuaagcaaccugguuagagccaaggaaaaugauaacggcgucaauuccaaaaacgugcuccccgugaaugggaagaucacaaccaugcugaaacaagacuggggacuuaacgaugucuggaaugacuugauucugccuagguucguucgaaugaacgaguuagcuaagacuaucgccuucacaucauggaaugaacagcaccagaaguaucucccaacggugccgcuggagcuuaguaaaggcuuucagaagaaacggauugaucaucgccaccaugcaauggacgcccuggugaucgcuugcgccaccagagaucacguaaaccuacucaauaacaagcacgcaaauacugacacaauaagguacgaucugcaacggaaauugcgacuguucgaaagagucaccuauauugacccccagacaaagaacaacgugacuaaagacaucccuaaggaguuuaagaaaccaugggauaauuucaccguugacgcgcgcaacgaguuagaaaagaucauugugucuuuuaaacagaaucucaggauaaucaacaaggcuacgaauauuuacaccaaauacgagaacgguaagaagaucaaagucgggcaaaagggccugaauugggccauucguaaaccccuucauaaggaaacaguguucgcaaaaguuagccugcggaagagaaagacugugagguuguccgaggcccucaaagauuggaagaaaaucguagacaagaaacugaagcaggaaauaaagcgccuaaccugucaguauggaaaauuugaugucgacacaauccugcgauacuucaaggauagaaaauaucaguuuggcgagguggacgugucaaaggucaaaauguacuauuucgaugaggaaaacgcugccguucggaagaauguggacacuagcuuuaccgagaaauucauucaagggucuguaacggauacaggaauccagaagauucuucucaaccaccuggaagcaaaggguaauaaaguggagaucgcuuucuccccugagggcauagaagagaugaacaagaauauuauccaguugaacgaagggaaacugcauuuaccaaucuuuaaggucaggguguacgagaccauuggaaauaaauucaguguuggcgugaaggguaacaagaaagacaaguaugucgaagccgcgaaagggacuaaucucuuuuucgccaucuacguggaugagaacggcauacgcagcuacgagacaauuccccugaacaucguuauugaacgucuuaagcagggacugucuguggucccggagaaaaauagaaaggaacacuccuugcucuuuuaucugucaccuaacgaccuaguauacgugccaaucgaggacgaacgggagaauauacacgcuguuaaccuggaucaacuuaauaacgagcagaggaagcgcauuuauaaaauggugaguugcaccggcagcgaaugucauuucguccccuacuauguggcaucgccuaucguaaauaagguggaguacuccucucucaacaaaaucgggcgaagccugacuggagaaaugauuaaggacgucugcaucaaauugaagguugauagauuaggcaauauuaaggguauaucagggcuguga

SEQ ID NO: 3430 - RNA, 4533 nt, Artificial Sequence
  Cas9 variant
augaagagaauccugggccucgaccuugggaccaacagcauuggaugggcccugguggauuccgaggaacagaggauauuggguaugggcucucggaucauucccauggaccaaggggucuuagauacauucucaggaggcaauccuguugagacucagacggcugcacgcaccgccuaccgagguacacguagacugagggaacgggcgcuacuccgcagagagaggcugauccgggugcuuaacaugaugaaauuucugccagaacacuaugcuagucagauugacuucgagaagcgcuuggggcaguuuuucgaugagaaagaaccgaagcucgccuggaaacaaaaugacgagggacgauuugaauuuaucuuucagcagagcuucaacgagaugauagaggaauuuaagaauaagggcguagugagagaggauaaaaagauccccuacgacuggacuauuuauuaccugaggaaaaaggcacugucccaggaaaucgagaaagaagaacucgccuggauuuuacugaacuucaaucaaaagcggggcuauuaccagcuucguggggaggaagaggaagagaacccuaauaaguuggucgaauauuacucucugaaaaucguggauguuauagcugacgagaagccaaacucgaaaggagauauuugguacucacuacaucucgagaaugguuggaucuaucgcagaagcaguaagauuccccuguuuggcuggaaagacaagaccagggauuucaucgugacaaccgaccuuaacgacgaugggacugucaaaaaggacaaggaaggaaucgagaaacgguccuuucgagcaccuucugaaaaugauugggugcuguugaagaaaaagacagagagcgacauugaaaaaucccacaagaccguaggcgccuacguuuaugagacgcuccugcagaacccaaugcagaaggugcgcgguaaauuagucagaacuauagagaggaaguucuacaaagaugaacugaagcaaauccucgagaaacagcgggaguuccaucccgagcuucgcgacgaggaucuguauaaugacugcgugagagaauuguacaggucaaacgagaccuaucaguuuauucuaaguaagcgugauuucgugcaccuguuucucgacgauauccuguucuaccaacggccucuucgaagccagaagucugcuauaggggacuguauucuggaauuuaaaacauacaaggacaaagauggaaacaauaucaaggaguauuugaaagucaucuccaagucaaacccacucuaccaggaguucagaauuuggcaguggcuguauaauuuaaagaucuacaggaaagaagacgaugaggacguuacucugcaauuuauugccaacauagaagauaaggagcagcuauucgacuuucucagcaaucgcaaaaguaucgaacagaagccgcugcuugaguauuugauuaaagcgaagggccugaaaaagcaagugaagaccgaagcauaccgguggaacuauguagaggauaaaaucuaccccugcucugagacaaagaccaugaucuccacgagacucgccaaaguggaaaauauuccugacaacuucuuuacuaaggagauagaacagaaacuguggcauaucauuuacagcgucacagauaagaaugaguucgaaaaggcucuuaggaccuuugccaaaaaguaugaccuggauaucgcaucguucguggacaacuucaaaaagauuccacccuuuaaaaaugaguacggcucuuucuccgagaaggcuaucaagaaauugcucccucugaugcgcuuagggaaguauuggaaauggaacgauauagacaauaacacucagaaucgaaucucaaagauuaucacaggagaauacgacgaggaaauuaaagauaucguucgggagaagaguauagcccugaccaacgagaacgacuuucagggucuacagcucuggcuggcgcaauaucuuguguacggccgucacagcgaagccgauauugcagggaaguggcacuccgucgcugacuuggagaaauaucugaaugaguucaagcagcauucucucagaaacccaaucguggaacagauuaucacggaaacccugaggguaguucgcgauauauggcggaaauacggacagggcgccgagaauuucuucagcgagauccacguggaauuagguagagacaugaagaacacagcugaugagaggaaaaagauugucaauguggucacugaaaacgagaauaccaaccugcgaaucaaagcccuuuugauggaacucaagaauaacucagacgggaagcuggagguggagaauguucgccccuacaguccgacacaacaggauauucuaaaaaucuaugaagaguacgcaauauccacuggccuggacaacgaaaaggaugagaaagugaaggaagacauuaaaaagaucagccggguagcccagccuaccacaaccgagcuccaaagauauaagcuguggcuugagcagaaauacuguucucccuauacuggaaaggucaucccauugggcaaacuguuuacggaagaguaccagauugaacauaucauuccuaagucaagguauuacgaugacaguuucagcaauaaagugauaugcgaggcugcgguuaacaaguuaaaggacaaaugucucgggcuggaguuuaucaagaauuaccacggacagauuguggaaacagguuucggccaaaaagucaccaucuuugaugaggaagcauaucagaacuucgugaagcagcacuacgccuauaaccguuccaaacgcacuaaacuucuguuggaggaaauucccgagaagaugaucgagcggcagaugaaugacaccagauacauaucuaaauuuguacucccacugcuaucgaaccuggugagggcugaagagaaugauaacgggguuaauagcaagaacguccuccccgugaauggaaaaaucacaaccaugcugaagcaagacuggggccuuaacgauguguggaaugacuugauucugccucgauucguccggaugaacgaauuagccaaaacuaucgcauucacauccuggaaugagcagcaucagaaguaucucccaacgguuccgcuggaacuuucaaaggguuuucagaaaaagcgcauugaucacagacaucacgccauggacgcucuggugaucgccugcgcaaccagggaucaugugaaccuacucaauaacaaacacgcgaauacugacacaauacgguacgaucugcaacgaaaguugagacuguucgagcgcguaaccuauauugacccccagacaaagaacaacgucacuaaggacaucccuaaagaguuuaagaagccaugggauaauuucaccguggacgcuaggaacgaauuagagaaaaucauuguuaguuuuaagcagaaucuccguauaaucaacaaagccacgaauauuuacaccaaguacgaaaacgggaaaaagaucaaggugggccaaaaaggacugaauugggcaauucggaagccccuucacaaagagacagucuucgccaaggugucucugagaaaaaggaagacuguucgcuugagcgaagcucucaaggauuggaaaaagaucguggacaaaaagcugaaacaggagauaaagcgacuaaccugucaguauggcaaguuugauguagacacaauccugagauacuucaaagaucggaaguaucaguuuggggaggucgacguguccaaagugaagauguacuauuucgaugaagagaacgccgcagucaggaaaaauguugacacuucauuuaccgaaaaguucauucaaggaagcgugacggauacagguauccagaaaauucuucucaaccaucuggaggcuaagggcaauaagguagagaucgccuucucuccugaagggauagaggaaaugaacaaaaauauuauccaguugaacgagggaaagcugcacuuaccaaucuuuaaagugcgcgucuacgaaaccauuggcaauaaguucuccguggguguuaaagggaacaagaaggacaaauauguggaggcggccaagggcacuaaucucuuuuucgcuaucuacgucgaugagaacggaauacguaguuacgaaacaauuccccugaacaucgugauugagagacuuaaacagggccugagcguugugccggaaaagaaucggaaagagcauucuuugcucuuuuaucuguccccuaacgaccuagucuacguaccaaucgaagacgagagggagaauauacacgcagugaaccuggaucaacuuaauaacgaacagcgcaagcgaauuuauaagaugguuucaugcaccgggagugagugucacuucgugcccuacuaugucgccagcccuaucgugaauaaaguagaauacucgucccucaacaagaucggaagaucucugacuggcgagaugauuaaagacgugugcaucaaguugaaagucgaucgguuagguaauguuaaggggauuagcggacuguga

SEQ ID NO: 3431 - RNA, 4536 nt, Artificial Sequence
  Cas9 variant
augaagaaaauccugggccucgaccuugggaccaacagcauuggaugggccgugauaaauuccgucgcugaugagucuguugaaaagagaaacaucgagcuggcagguucaaggauuauccccauggacgccgcgguguugggcaauuucgauaacgggguaacaaaaagucagacugcugaacggacgagcuaccgcuccauucgacguuuaagagagaggcaacugcuacggcgcgaaagacuccacaaggugcugcagauccuuggauuucugccugagcauuaugucaaugacauagauuucgagaaccacccaggcaaaaucaagaagaauaccgaaccgaaauugcccuggaggaagaacucuaugggucaguuugaguucauuuuucaggccucguucgaagcaaugcucacagacuuugccacucaucaaccuguguucguuucagaggggaaaaaggugcacuacgauuggacccuguauuaccugcggaaaaaggcucucacagaggaaaucagcaaggaggaauuagcauggauuauccugaauuuuaaccagaaacgcggauauuaccagcuucgaggcgaggaagaggaggaacagaguaauaaguuggucgaguucuaugcccugagagugguaaaaguugaagcuaccgacgauaagaaaggcaaggacacuugguacaacgugcaucuagagaauggguggauauacaggcggacauccaacauuccacucgauugggaaggaaaagucaaggaguuuaucgugaccacggaccugaaugaggaugguacucccaaacuugacaaauauggcgaagugaagcguucuuuccgcgccccuaaagaggacgauuggacccugauuaagaaaaagacagaaagcgacaucgcgaacucccacaagacuuuggggugcuacaucuaugaugcacuccugcaaaacccaaaucagaaaauuaagggaagauuagucaggaccguugagcggaaauuuuacaaggaggagcugcgacucauacuugagaaacagcugucauuccaccccgaauugcaggaccgcgaucuauauagagccuguaucgacgcucuguacgugaguaacgaggcccauaagaauaacauuagcggcagggauuucguauaucucuuuaucgacgauauaauuuucuaccaacggccucugaagacaaagaagucucuuaucgacaauugcccauacgagaaaaaccaguauauggaucgcgaaaccggugaggugaagcaggcaccgaucaaauguauugcuaagucccacccccuguuucaagaauuuagauuguggcaguuuaucucaaauauuaggauauaccagcgugagcgggucauggacgacgggaagcucgaaacggauguggacguuacuccugauuuccugaaaacagaggacgauuauaccacuuuauuugaauggcugaacgaccgaaaggagguggaucagaaagccuuccuaaagaauccacaauuuggacucaaaaagacauucaccgaguacagauggaacuaugucgaagacaaaagcuaccccugcaaugagacgaggaacgcgauccugaauggccuucagaaggccggcgugagugcagauuucuugucucgcgaaguagaggaagcucuguggcauauucucuauuccguugaggacaagaucgagaucgaaagcgcccugcggaaauucgcuucgaagcacgaucuugacgauagauuugccgacguguucaaaaagcugccuccauucaggaaagaguacggggcauacucugccaaggcuauuaagaaauugcucccccugaugcgcaugggaaaguauugggaauuauccaacauagacgauaaaaccaaggagcgaaucgacaaaauuaucacaggugaaugggaugagaauauucacaaccggguccgugagaaggcgaucaagcugucagacauaacugauuuuaaaggccuaccgcucuggcugaguuguuacguggucuauaacagacauagcgaagcaagggccaucgcuaagugggaguccccugaagacauugauucuuaccuucgcuuguuccggcagcacagccugagaaaucccgugguugaacaggugaucaccgagacacucaggacuguacgagacauuuggaaacgcaucgggcaaauagaugaaauucaugucgagcugggacgggaaaucaagaacccagccgacaaaagagcaaagaugaccgcccagauuguggagaaugaaaacacaaauuuaaggaucaaggcucugcuugccgaguuuauaaacucagaguaugaaaucgagaauguucguccuuacagucccggccagcaggaaauuuugcgcaucuaugaggauaccgugcucaacuccgucgaagagauuccagaggacaucagcgcagugcugaaaaaguuccgggaaucugaucugaaaaagagacccacuaaaucagaguuucugagguacaagcucuggcuggaacaaaaauaccgaaguccuuauacgggugacauaauuccacuugggaaguuguucacaagcgcguacgagaucgaacacaucauuccgcagucccgguauuuugacgauucuuucucgaauaagguaaucugcgaggcugaggugaacaaacuaaagagcaaugaauuaggcuacgaguuuauuaaaaaccaucacggacaguauguugaaauaggcuucgggaaggucgugcagaucuuuuccauugaggccuacgagaaauucgugaaggcaaauuauucaggaaucgguaguaagaugaaacgccuccugauggacgauauucccgaaaccuuuaucgagagacaacuuaacgacucuagguacauaagcaaggucguuaaaucccuguugucaaauaucgugcgggaaaaggauagcaacggcgaguacgaaccugaggccauuucuaaaaacgugaucguauguacuggguccgucaccgaccgacucaagagagauuggggagugaaugacguuuggaacaguauuaucuauccacgcuucgagaggcugaaugaacuaacaggcagccagcaguucgguugcugggagaacaaggaagggaaacguguguuucaaaccgcugucccccuggagaugcagaagggcuucucuaaaaagcggauagaucacagacaucacgccauggacgcaauugugaucgcuugugccaucaggaaucauauuaacuaccucuccaaugaaucagcgaguaaaaaggccaagauaagccgcaucgaucugcagcgacuuuugugcacuaaauguagaacagacgacaacggaaauuauaaguggauuguuaaaaagccuuggccagcuuuuacgcaggauauccggaaagcacuggagaacauuaccgugucguucaagcaaaauuuaaggguaaucaacaagacuacaaauuacuauguccacuuugacgaguccggcaaaaaggugcucgaaaaacagauaaacggggauucuugggccauccgcaagcccaugcacaaagacaccguguucggaaaggucaaucugcagaaaguuaaggaggugcgucuuagccuggcucuagauacaccgaagaugauuguagacaaaaagcucaaagaaaaggugcugcaguuguacucauauaaauacgauaagaagagaaucgacaaauacuuuaaggagaacgccagucuguggaaagauuuaaaccucuccaaggucgcaguguauuacuucacuaaugacucuaccgaaccucugguugcggugcggaaaccacuugauacgagcuuuaacgccaagaagauuaaagaguccgucaccgacacagguauccaaaagauacuguugaaucaucucucaaacaaucaggauaaccccaaucuggcuuucagcccugacggcauugacgagaugaacaggaaucuaacuacccugaacgaugggaaauaucaccagcccaucuacaaggugcgcguuugcgaaccacagggaaauaaauuuagugugggcacaucugguaacaagacuuccaaguaugucgaggccgcaaaagggaccaaucuuuucuucgcuguauaccaaacggaagacggcaagcgaaacuaugagacaaucccucucaaugugguuauugagagagaaaaacuggagugggcccccgugccagaaaacaauaacaacggagauaaguugcuguuuugguuaagcccgaaugaccucgucuacgugccuaccgcagaugagcugaacaauggcaugcggcuugacaacauggauaaagggaggaucuacaagaugauaucgugcucaggaccccaguguuucuuuauuccacagaauguaucuaaccccaucauuccugugaucgaacugggcgucaauaacaaagccgagaagaguuggaauaacgagaugauaaagguugugugcgugccaauucgcgucgacagauuggguuguaucacucaaaucaauaaccagaaauga

SEQ ID NO: 3432 - RNA, 4539 nt, Artificial Sequence
  Cas9 variant
augaagaaaauccugggccucgaccuugggaccaacagcauuggaugggcccugauagaaaauuccuucacagaaaaggaggguaaaaucaacgauaugggcgugagaauuauccccaugucugcugacauuuuggggaaguuugaugcaggacagucacacagucaaacugccgaaaggacgggcuaccgggguacccgccgauuauaucagcgugacaaucugagaagggagcggcuacaucgcguccuccacauccugggguuccuuccuaaacauuacgaugaacacauagacuuugagaagagacugggacaguucaaggagggcaaagaaaucaaguugaacuauaggugcaauguugagaacaaacaugaauuuauuuucaucagcuccuuuaaugagaugcucacagaguucaagaaagcgcagccagaacuguuuuaccugaagucuaacggcgaggaaacuaagauuccguaugauuggacccucuacuauuuacggaaaaaggcucugucgcaaccccuuacaaaacaggaguuggccuggaucauacugaauuucaaccagaagcgcggguacuaccagcuacgaggagaagagauugacgaugacaaaaauaagcaauuugugaaacucaagguaaaggaggugaucaacucaggugaagcagucaaaggcaagccucuguucgaugugauuuuugagaauggguggaaauaugacaagcagguugugaaaaccgaagauuggaucgacagaacuaaggaguucaucgucacaaccaaggugcuuaaaaacggagaccugaagaggagcuacaaaacgguagauagugaaaaggacugggccgcuauuaaagcaaagacugagcaggauauagagcgguccaauaagaccguuggcgaguucaucuaugagacauugcucgaaaacccaacucagaaaauucgugguaagcuggugaaaaccaucgagcgcaaguuuuacaaagaagaguuaaagaacauacugauuaagcaaaucgagcuccagcccacacuuuucucugaagaacuguauaaagccuguaucgaagaguuguacccuagaaaugaggcucaccagaacgccauuaagaauagggacuuuaucuaucuacugauggaugacauuauauucuaccaacggccacucaaaagccagaaguccaacaucucagggugccagcuggaacagcgagucuacuauaaagcgaauaaggauaguggagagaacgaagaggugaaacaagcagugaaggccauucccaagagccacccucuuuuucaggaguuccgcaauuggcaguggcugcagaacuugaaaaucuacaauaaggucgacaccgagaaaggcgagcucacggauguuacuaagcaacuguuaccaucugaagacuccugggugaaccuguuuaauuuccuacaguguaaaaaggagcucgaacagaagcaguuuaucaaauauuucauugauaagaaacugauaaacaagacagagaaagaccauuacagauggaauuauguagaagacaagaaguacccguuuaccgagacuagggcucaauucaucucacggcuuacaaaaguggagggcauugaagagaucaacaccuuuuuggauaagaaaacgcagauugggaccaaggacaauagccccuucgucagucgcaucgaacagcuguggcacauaaucuauucuguguccgauauuaaagaguacgaaagcgcccucgagaaguucgcaaucaagcaucaccugaacgaggaaucguuuguugcuaacuucauuaaauuuccuccauucaagucugacuacggauccuauaguaaaaaggcccuuaauaaacuguugccccucaugagaagggguaacuacuggacagagaaugauaucucagaaaaggugaaacugcgugucagcgagauaauggagcgggugaacgcguuaaaucugaaggaagacuauuccucuaaggagcuagccgaaacucucguaaacguuagcgaugacgaugugaaaaagcagcugauuaaaucauuugucaguuucaaggaccgaaauccucuuaugggcuugaacaccuuucaagcaacauaccugguguaugggagacacuccgaggucggagauauccagaauuggaaaacuccagacgauauugacaccuaccucaagaacuucaagcagcauagccugaggaaucccaucguggaacaaguugugacagagaccuuacgcguaguccgggacauauggaaacaccauggcaagucucagacuaacuuuuucaaugagauccacguggaacuggguagagagaugaaaaacccggcugauaagaggaaacgcauuucagaacgaaauacggagaacgaaaacacaaauaaccggauccgugagauucuuaaggacuugaugaaugaugccaguauccagggggacguuagagauuauagcccuucccagcaaggcauacucaagauuuacgaggaaggaguguaccagaaccccaaagucgacuauucuaaggugucggaggaugaaaucaccaaaaucaggcgcagcaauaacccaacucagaaggagauucagcgguacagacuguggcuagaacaaggcuauaucuccccuuauaccugcaaacccauuccacugucaaagcucuuuacacaucacuaccagauagagcacaucauuccccagaguagguacuucgacaauucuagcuccaacaagaucauuugugagucagaaguaaaugaggauaaagacaacaagaccgcuuuugaauaucugaaagauaagggggagaaugugaucaacggacauaaacuuuugagccuggccgcauacgaggcccacguuaauaaguacuucaagaacaaucgacagaaauuaaagaaccuccugucugaagacauaccugaggguuucaucaaccgccaaaugaaugauucccgguauauuaguaaacuugucaagggccuguugagcaacaucgugagagaagagggggaacaggaggugacuucuaaaaaucucauuccagucacaggauccguuacgucaaagcugaaaaacgacuggggccuaaaugacaaguggaacgagcugauccucccgagguuuaagcgucugaaucagcuuacccaaacuaacgauuucacaaccgcuaauacaaacgguaauacuauacccaccgugccugacgaauugcugaaaggguuuaguaagaaacgcauugaucaucggcaccacgcguuagacgcacucgugguagccugcuguacgagaaaccauagcaauuaccugucggcucuuaacaccgagaauaagaacuauggccugagggauaaacuacucaucaagaaugacaacgaucacuacacaaaguccuuccagaugccauggcauggauuuacuaccgaagccaaaaaccagcuggaggaaacagucaucucuuucaagcagaauuugcgagugauuaacaaagcaaauaacaaguuuuggagcuauaaagacgagaauggcaagcugaacuuagauaagaaugggaaacccauaaagaaacuccggaagcaaacuaaaggagacaacugggccguucgccagccucugcacgaggaaaccaucucagguauugugaaucuuccaugggucaaggcugagaaggaaaaauucacguacgccacaagaaagagucuggauaaauccuuugacuugaagaaaaucgagaagauuaccgacacuggcauccagaaaauacucaggaacuaucugaugcaggaaaaguucaaggagcuagauaaaaaggacaaagagguguacaauucugaacuggcauuuagccaagaggggcuugaagaucucaacuccaauaucgagcaguucaacgaccagaagccccauaaaccgauuuacaagguucggcuguucgagaagggaucaggccgauuugcguuggguuucaaagggaucaaugcuaagaaauaugcccagggcagcccuaaccuguacuuuaacauuuauagaaaugaagauggacaauacuaugagacagugccauuaaacaagguaaucauacaccagaaaaaugcagccaacaugcccaagaagaaucgcaccccuguccccauuaguaacacugcuaucaauaggucuaaagaagugcucguggacuacaagaugacccuguccccacuugaucuggucuauaucccuacagaggaagaguugaacaauauuaacagccucgacuucaauaaccugucgaaaucacagcguaagcggcuauacaauguuaacgauuuuucuggcuacacgaucuauuucagucccaauacccuggccaaauccauaugcccaaaggagguggacaugaaguuugaugagaaaaagcagaaaccgacugggagcuucgacucuaagacagcaagccuugauggaauguccauuaaagaaagauguaucaagcucauuaucgacaggcugggcaacauaucaaaagcuuga

SEQ ID NO: 3433 - RNA, 4539 nt, Artificial Sequence
  Cas9 variant
augaagaaaauccugggccucgaccuugggaccaacagcauuggaugggccguggucaaugcugaugagauaacaagagacgaugguuccagguaccugaagcccaacggcaucucugcagccgggucacggauuaucccuaugagugcggacauuuugggagauuucgaaaaaggcaauagcaucucccagacugcugagcgcacgcgaaugcguauggccagaagguuacacgaacgggcacugcuacgcagagagaggcuccugcggguucuuaaccuguuggacuuucucccaaagcauuucgccgauaaaauagaccgcuaugguaaguuuaccgaugacucugaaccgaagcuggcuuggcgaaagaauacagaggggaaguacgaguucaucuuucaagaugcauucaacgaaaugcuggccgaguuuaaagacaagcagcccgaaauuguggaggagggcaaaaagaucccuuaugauuggacuauuuacuaucucagaaagaaagccuuagaaaaggcccugucgaaagaggaacuuucauggaucuugcugcaguucaaucagaagaggggauacuaucaacuacggggcgaggaagaggagauaccacaggacaaaaagauugaauaccucgcgcagaaaguagugaaggucgaggcaaccgaccagaagaaaggggaugacgugugguacaacguuuaucuggaaaauggaaugaucuaccgucgcacaagcaaggcuccccuugauugggaggguaaagugaaggaauuuauugucaccacugagguggagaacgacggcgaaacaccuaaaaaggauaaggaggggaauaucaaaagaaguuucagggcuccaaaggaagacgauuggacccuguugaaaaagaaaacggaggccgacaucgaaaacucccacaagacuguaggaugcuauauuuacgauucucuccugaauaaccccaagcagaaaauaaucggcaaguuaguucggaccguggagcgaaaauuuuauaaggaggaacugacacaaauucucaaaaagcaggucgagcuuaucccugaacugcgcgacgauaauuuguacaagcaguguauagaggagcuauauccaauuaacgaagcacauagaaacacuaucgcuaaaaccgacuucgccaaucuguuuaucaacgacauucucuucuaccaaaggccguuaaagagcaaaaagucccagaucgauaauugccccuacgaggaacggauuuucauagacucaaaaacaggugagaagaaaaaggugccugugaaguguaucgcgaaaaguaacccacuuuuucaggaguuccgccuguggcaauuuauucagaauuugagaaucuaucagagggaaaaggagaucgaugggaaacuccugaccgacauugauauaacgagcgaaugcuuaaagucugaggaagacuacguccgucuguucgauuggcuaaacgaccgggagacuaucgaacaggaggaucuccugaaacaccuuuuuaauacaaagaaguccaaaaacaaggagaaucccuaucgauggaacuacguugaagacaaaguguauccuuguaaugagaccagagccacuauuuugaagggauucucaaaaugcggcaucaacgcaagcguacugaguccagaacucgagauggcucuguggcauauucuuuacucuguggaagauaagaaggagaucgagacagcccugacccacuuugcucaaaaacagggcuggaaugacgauuucgccaaggucuuuuccaaagcaaagcccuucaaaaaggacuaugggagcuacucggaaaaggccaucaaaaaguugcucucucugaugaggaugggaaaauacuggaaccaggacaauauagauaagaacacguuagaccgcauugauaaaaucauuaacggugaguaugacgaaaagaucuccaaucgggugagagauaacgcuauaaaucugaaagacauuucagauuuuaggggccuaccgguuuggcucgcguguuacaucguguaugaccgccacagugaggcaaaggauugcaccaaguggaacagcccugaggaaauugacuccuaccugaaaaaguucaaacagcauucucuucgaaaucccaucgucgagcaagugguaacagaaacuuugcggaccguucgugauauauggauccaggaggaacagauugacgagauccaccuggagcucgggagagaucugaagaacccagccgacaaaaggaagaagaugagcgaaaauauucugaaaaacgagaauacaaaccugcgcaucaaggcuaugcuuauggaauuuaugaauccuucaaugggaauagagaacgugcggcccuauaguccaucccagcaagacauuuugagaaucuacgaagagaaugcccucgauaaccugacuaaagacgauaaggacuucgauuucaucagcaaaauuucuaagcaggcacagcccucaaagaccgacaucauuagguauaaauguuggcuagagcagaaguaccgaaguccuuacacaggcaaaaccauaagccuguccaagcucuuuacuccagccuaugaaaucgagcaugucauuccgcaaucucuguacuucgaugacucguuuagcaauaaagugaucugcgaagcugaggucaacaaacuuaaggaucgccaguuggguuauaaauucauugccgaacaccacggggagaaggugcagcugucccaaggcgagguuguggaaaucuuaucaguagacgcauacgagaaauuugucaaggaaaacuaugcgaauaaccggauaaaaaugaagaagcuccugauggagaguauccccgaugaguucauugaaagacagcuuaaugacucuagguacaucagcaaagugguuaagggacuguuguccaacauugugcgugagaaaaucgacgaugaaaauuaugagccugaagcugucucaaagaaccucauaagcuguaauggcgccauuacggaccgccugaaaaaggauugggggaugaacgacguguggaacucuaucauccuaccacgguuuauuagaaugaaucagauaacaggaaaagauugcuucaccacuaccaaugcagagggucaucugaucccccagaugccucucgagcugcaaaagggcuuuaacaagaaaaggauugaccaccgacaucacgccauggaugcuaucguaauugccugcacaacccgggaccaugugaaucuuuugaacaaugaagcagcucacuccaaguucaacgccacucgcuaccagcugcagagaaaauuaaggcgguuugagaaggcgguuaucgaugggaaagaacgagaggucgccaaggaguuccucaagccaugggacaguuuuagcucugauuccaaaaacauacuggaaaauaucauugugucauucaagcagaaccaaagagugaucaauaaaacaacgaacgcuuuccuucacuuugacgagaauggaaagaaaaccuucauuaagcagggcaagggugauaguugggcaauccgcaaaagcaugcauaaggacacugucuuuggggaaauaaaccugaggaaaguucguucggugucccuaaaugaggccauuaaggugcccgaacggguacucaacaaaaagaucaaggagaaaauccuggaauugaagaauaacaaaauugacgcuaagaauaucaaaaaguacauagaggagaaccacacaggcggauauggcauugauucuagcaaaaucgacgucuucuacuuuaccaaggaaacaaaggagagauucuuugccacuaggaaaacccuggauacgucauucaaucaggcaaagauuaaagacaguaucgcggauuccgggauacagaagauuuuacucgcccaucugaaaucuaagaacggagacgcugaacaagccuuuagcccggaugguaucgacgagaugaauaagaacaucguggagcuuaauaacggcaaauuccaccagccuauucugaagguucgcguguaugaaaaagcagauaaguuugcugucgggcagaaaggaaacaagaaggugaaauucguugaggccgcaaagggcaccaauuuguucuuugccaucuucgaaaaagacgguaagcgauccuaccucacaauuccacugaacgugaugauagauugucaaaaacaguaugggaaucaguggaagaacaauaucgaggcuuaccuaaaggaaaaagagcugguagagaaggacgucaaacuucaguuuauucucucacccaacgaucugguguauuugccuacugaaggcagcaucgacaagaaaagaaucuacaagguggucaguuucaccaauaaccggcuguacgcgauucccuaugccauagcaaaaucuaucguugacaagaaugaguuuacacaauuaaacaagauugaguucacugauaauaaagaauccaucaaggacgcuugcgugccaguaauuaucgauaggcucggaaacgugauagaauuuaauggcaaacgccuguga

SEQ ID NO: 3434 - RNA, 4539 nt, Artificial Sequence
  Cas9 variant
augaagaacauccugggccucgaccuugggaccaauagcauuggaugggccgugauaaacuccgaggaagauggucccaucgucaaaaagagaauugagcuggcuggcucuaggaucauuccuauggacgcagccguuuuggggaauuucgauucaggagugacaaaaagucagacugcggaacggacgagcuuucgcuccauccgacguuuaagagagaggcaacugcuacggcgcgaaagacuccacaagguacugcagauacuuggcuuccugccagagcauuacgugaacgacaucgauuuugagaaucacccggguaaaauuaagaggaacaccgaacccaaguugccuuggcggaaaaauucuauggggcaguucgaguuuaucuuccaggacucguuugaagcuaugcucacagauuucgccacucaucaaccagucuuugugucagagggaaagaaaguucccuaugacuggacccuguacuaucugcgcaagaaagcacucacagagggcauuagcaaggaagaguuagccuggcugauccuuaacuucaaucagaagcgaggcuacuaucaguugagaggggaagaggaagaggagcagaguaacaaacugguggaauuuuacgcucuaagggucgugaagguagaggcaaccgaugacaaaaagggaaaagauacuugguauaauguucaccucgaaaacgguuggauauaccggcguacauccaauauuccucuggacugggagggcaaggugaaagaauuuaucgucaccacggaucuuaacgaggacgggacuccaaagcuggacaaguacggagaggugaaacgcucuuuuagagcccccaaggaagaugacuggaccuugauuaaaaagaaaacagagagcgauaucgcuaauucccauaagacugugggcugcuauaucuacgacgcccuccugcaaaacccucaccagaagauuaaagguagguuaguccggaccguugaacgaaaguucuauaaagaggaacugcgccucauacuugagaagcagcugucauuccacccagaguugcaggauagagaccuauacagggcguguaucgaugcacuguaugugaguaacgaagcccauaaaaauaacauuagcgggcgggacuuuguauaccucuucaucgaugacauaauuuucuaucaacgcccgcugaagacaaagaaaucucuuaucgauaauugccccuacgaggaaaaccaguacauggacagagagaccggagaggugaagcaggcuccuaucaaauguauugccaagucccacccacuguuccaagaauuuagguuguggcaguucaucucaaauauucguauauaucagcgggagcgaguccucgacgauggcaaacuggaaacggacguggauguuacucccgacuuuuuaaagacagaggaugacuacaccacucuguucgaaugguuuaacgauagaaaggagguggaccagaaagcauuccuaaagaauccucaauuuggccucaaaaagacauucaccgaguauagguggaacuacgucgaagauaaaagcuauccaugcaaugagacgcgcaacgcuauccugaaugggcuucagaaggccggagugagugcggacuuuuugucucgggaaguagaggaagcccuguggcauauucucuacuccguugaggauaaaaucgagaucgaaagcgcacugagaaaguucgcuucgaagcacgaccuugaugacagguucgccgacguguuuaaaaagcugcccccguucaaaaaggaguauggugcuuacucugccaaagcaauuaagaaguugcucccucugaugcgcauaggcaaauacugggaauuauccaacaucgaugacaagaccaaagagcgaauugauaagaucauuacaggggaaugggacgagaauauccacgaucggguccgugagaaagccauaaagcugucagacaucacugauuuuaagggacuaccccucuggcugaguuguuauguggucuacaacagacauagcgaagcuagggcgauugcaaaaugggaguccccagaagacaucgauucuuaucuucgcuuguuccggcagcacagccugagaaauccuauuguggagcagguuaucaccgagacacucaggacugugcgagacauauggaagcgcguaggccaaauugaugaaauccaugucgagcugggucgggaaauuaaaaaccccgccgacaagagagcuaaaaugaccgcccagaucguggagaacgaaaauacaaacuuaaggauaaaggcacugcuugccgaguuuaucaauucagaguacgaaauugagaacguucguccauauaguuccaaucagcaggaaaaguugaaaaucuacgaggauaccgugcucaacggggucaaggaaauucccgaggacaucaauacuauacugaaaaaguuccgcgagagcgaccuuaaaaagcggccuacgaaaucugauuuucugcacuauaagcucuggcuggaacaaaaguacugcucaccauacacaggcagaauuaucccgcuuggaaaauuguucaccagugcuuaugagaucgaacauauuaucccccaggcccacuacuuugacgauagcuucuccaacaaggugauuugugaggcagaaguaaauggccugaaagacaagaaauuaggguaugaguuuauaaagcacaacccuggaaagaugguggagaucgguuucggcaaaccacccguuaggaucuuuucugucgaagaguacgaacgauucgugaaggagaauuauucggggauuaaaaacaagaugaauaaacuccugauggaugacauuccugagacuuucaucgaacggcagcuuaacgauagccgcuacauauccaagguggucaagucacuguugaguaauaucguuagagagaaagacucuaacggagaauaugagccagaagcgauuagcaagaacgugaucgugugcaccggcuccguaacagauaggcucaaacgggacuggggugucaaugauguguggaacucaauuaucuacccccgauuugagagacugaaugagcuaaccgggagccagcaauucggcuguugggaaaacaaggagggaaaacgcguuuuucagacugcugugccgcuggaaaugcagaagggcuucucuaagaaaaggauagaccaucgucaccaugccauggacgcaauugucaucgccugcgcuacacggaaucacaucaacuaccucuccaaugagagugccagcaagaaagcaaagauuucuagaacggaucugcaaaggcuuuuguguaccaaaugccgcacugacgauaacgggaauuauaaguggauagugaagaaaccuuggccagcuuuuacacaggacauccgaaaggcccuggaaaacauuaccguuuccuucaaacagaauuuaagagugaucaacaagacaacuaauuacuauguacacuuugaugagucagguaaaaagguccucgagaaacagauuaacggagacaguugggcgauccggaagcccaugcauaaggauaccguguucggcaaagugaaucugcaaaaggucaaagaaguuaggcuuagccuggcccuagacacgccuaagaugauaguggauaaaaagcucaaggagaaaguacugcaguuguacucguauaaguacgacaaaaagcgcaucgauaaauauuuuaaggaaaacgcuucccuguggaaggacuuaaaccucucuaaaguggcagucuacuacuucaccaaugauagcacagagccccugguggccguucguaagccacuugacacuucauuuaacgcuaaaaagauuaaagaaagugugaccgacacagggauccagaagauucuguugaaucaccucuccaacaaucaggaugacccuaaccuggccuucucucccgauggaaucgacaagaugaauaaaaaccuaacugcacugaaugauggcaaguaucaucaaccaauauacaaagucagagugugcgagccgcaggguaacaaguucagcguugggaccuccggcaauaaaacgucaaaguauguggaggcggccaaaggaacaaaccuauuuuucgcugucuaccagaccgaagacggcaagcggagcuaugagacuauuccucucaauguagugaucgaaagggagaagcugggguggacacccguuccagagaacaauaacaauggagauaaauugcuguuuugguuaagucccaacgaccucguguacgucccuaccgccgaugaacugaacaauggcaugcgccuugacaacauggauaagggucgaaucuauaaaaugauuucuuguuccgggccacagugcuucuuuaucccccaaaaugugagcaacgcaauaauuccuguaaucgagcugggagcuaauaacaaggccgaaaaaucguggaauaacgagaugauuaagguggucuguguuccgaucagaguggaccgguugggcugcauaacucagauuaauaaccagaaguga

SEQ ID NO: 3435 - RNA, 4551 nt, Artificial Sequence
  Cas9 variant
augaagaacauccugggccucgaccuugggaccaauagcauuggaugguccgugauacaggagaaacacaacgaaaauaacgagugccaaaagcugaucuugggugccggcucuagaauuauccccauggaugcugcagucuuaggggacuucgccaaaggaaauacaauuucacagacuaaggauaggacgcaguaccggggcguucgccgacugcgugaaagaugucuacucaggcgggagcgccuguuuagagugcuugacaucauggguuuccugccucagcauuuuaguaacgcguugaccagguaugggaaauucaaggaugcugacgaggaaccaaagauagccuggcggaaagaugacgagggaaagaugcacuuucucuucgcagauagcuuuaaugaaaugaucgaggaguuccgcuccguacaaccggaacugcugaaacgaggcaugaaggugcccuacgacuggacacucuauuacuuaagaaagaaggccaugagggaggcugucacuccuuuugaacuggcauggcuuauuuugucuuucaaccagaagcggggcuauuaccagcugcguggggaggaagagggagaagccgauaauucgaaaucagaggaguaucuagcucagcgcgugguugacgugaucgauaccggugaaaagaaaggcaagagcacaugguuugacauuguccucgagaacgggaugguguaccauagaccagccgaaaucaaacccgacuggauaggaaagaccaaagaguucauuguaacuacacaauuugauaaggacggcaauccuaagaaagauaaggaagguaacguuaaaaugaguuucaggaugccaaaugagaacgacuggaaucugcagaagaaaaaggcggagaaggauaucgacgaauccgggaugaccgugggagaguacauuuauaacgcacuucugcacaaccccaaacagaagaucaaaggcaaguugguccgggugguggaacgaaaauacuauaagaaugagcuccagaagauccuggaaucucaaaaacgcuucauuccucaguuaagcgauuccgcccuguacgagaagugcauaaaagagcucuaucagucaaacgaggcuuacagaaauaguaucagcacgaggaacgacuuuacuuaucuuuucgucgauaauauuaucuuuuaccaacggccacugaagucuaaaaaguccuugauagacaacuguccguacgaaucacuagccuauaccaaggauggcgaggaacauaaagcacccguuaagugcauugcuaaaagccacccucuguaccaggaguuccgccucuggcaguuuaucaguaaucugagaaucuaucagaggcaaaaacaggugggggacaaaguaaaacuugacguggaugucacagacgaguuccugccaacugaugaccgucgggaaucuuuguuugauuaccucaacgacaaaaccgaaauuaagcaggaugugcuguuaaaggaguucuuuuccaugaaaaagcccaaaggaaaggacagcguuuauccuuaccgauggaauuauguggaagauaaaucguacccauguaacgucacaagagguaagauccuggccaagcuaaauagggcgggcauuucugccgacuuccucuccucaaacgggaaugaggagagucuguggcacauacuuuacagcguggaagauaaaggagaguugcgcaaggcacuggcucgguuugccgcuaaaaacggccucgacgaugccuucaccgaagcacuggccgacaucgagcccuauaagaaagaauacggugcuuauuccgcgaaggcacuuaagaaacuguugccgcucaugagacuggggaaguacuggaauuaugacaacauugccccugcuacgaaagccaggaucucuaagaucauugauggcgaguacgacgagaacauacgcaaucgaguacgggaaaaagcaaugagcuuaaacucagccagucaguuucaaggacugccccuauggcucgcuugcuauaucguuuacgaucgucauuccgagagagccgacagcgggagguggucuucaccagaagauauugacaaguaccugagugauuucaagcagcacagccuucgcaauccuaucguggagcaggucgugacugaaacauugcggaccgucagagacauuuggaaaagguauggggagaucuccgagauacauguggaacugggacgagagaugaagaaccccgcagauaaacgcucuaagaugaaucggagaaugcucgaaaacgagaaugcgaacaugagggcuaaacuguuacugacugaguucaugaauccagaauuugguaucgagaacguucguucguacagccccucccagcaagaacuuuugcgcauuuaugaggacggcgccaucucaaaugcagggagugaaauugaugacgagaucucugauauaaugagccggcucucccagguggacguaaagaaacagccuacagccucagaggucaagagauacauucuguggcuagaacagaacuauaggagcccauacaccggacaaaugaucccgcuggcuaaacucuucacgcccgccuaugagauugaacacgugaucccucagucucgauacuuugacgauuccuucaguaauaagguuauaugugaggcagaagugaacaagcugaaagaccggaugcuuggcuacgaguuuaucaagcagcacaaaggugagaaggucagcuugucuaugggcggcaccguggaaauucuguccccagaggaauauguacgccauguggagucacaauacaagaauaacaaagcuaagaugagaaaauuacucauggaugacauccccgaugaguucauuaacaggcagcugaaugacagucgguauaucagcaaacuuauaauuucgcuguuguccaacaucguucgagaagagggagaagaggaagccacaucuaagaaugucaucagcugcaacggcucaauuacugauagacucaagaaggacugggggaucaaugauguguggaaccacauuauacugccucgcuuuaggcgucuaaaugagcugaccggaacagacaaauucacuaccaguaacaaggagggucaugaagugccagagaugccccucgaacugcagaaaggcuuuaauaagaaacggaucgaucacagacaucacgcgauggacgccauugucaucgcuuguauuacaagggaccacguuaaccuuuugaauaacgaggcagccauguccaagaauaacgcuaaucgcauccagcugucuaagaaauuacgaagauacgaaagcguggagauagagaaggaugggauccggaaacaaauuuccauggccaaggaguucaaaaagccgugggaaggauuuaccgcagacguggaaaggacucuccgcgauaucguagucucauucaagcagaaccugcgugugauuaacaaaacgacaaauuauuaccagcauuuuaaggacggcaaaaagaucuauagcccucagaguaaaggugauucuugggcgauaagaaaguccaugcacaaagagaccguuuucggggaaauuaacauccggaggaucaaggaggugagccuuaaggaggccaugaaacgcauuaaggacauagcugauaaagaacugcgaucgaagaucgucgagcuaauggcccuccaauacaaugaaaagaagauuaagcaguacuucucagacaacaaagaugaguggucugacgugaauccaaagaaaaucaagauucauuauuuuacuaaagaaaccaacgagagauucuuugcaacacggaagccccuggauaccaguuucgacaagaaaaagaucaaaacucagguugcugauacagccauacagaagaucuugcugaaucacuuauccgcacacggcgacaaagccgagacggcuuuuagcccugacggaauugaugaaaugaacaggaauaucauugagcucaacgacggcaaguuccaucaacccauccugaaggugcgcauauacgaaaaagcggauaaguaugccguagggcagcagggaaauaaaaagaaaaaguacgucgaggcagcuaaaggcaccaaccuguuuuucgccauuuaugccgaggaaaagaucgacgagaagacuggugauacagugaucaccagaacauacgacucuauuccacuuaauguggucaucgauagggaaaaacggggguugagcccuguucccgagaacgaaaauggagcuaagccaaaauaugugcucuccccgaacgaccugguauacgugccuaaugaggaggaacgugagacuggccgcauaugcgaaccccuagauaaggagcgaauuuacaaaauggucucaaguaacaagaagcaagcauuuuucaucaaaagcgaaguggccucuaccauuguugacaaguuugaguucuccgcgcugaacaaacaggagagagcucuuucaggugaaaugaucaaggagauauguauuccaaucaguaucaauaggauuggcgaaaucacgcuccgguga

SEQ ID NO: 3436 - RNA, 4554 nt, Artificial Sequence
  Cas9 variant
augaagaaaaucgugggccuggaccucgggaccaacagcauuggaugggcccuuauaaaugcuuacaucaacaaggagcaccuguaugguauugaagcaugcggcuccagaaucauucccauggaugccgcgaucuuggggaauuucgacaaaggaaacucuauaucacagacagcugauaggacgaguuaccggggcauccgccgauuacgugagagacaucugcuaaggcgggaacgccuccacaggauucuggaccuucuggguuucuugccuaagcauuauagcgauucccucaauagauacgggaaauuccugaacgacaucgaguguaagcugccaugggucaaggaugaaacuggaucuuauaaauuuauuuuccaagagucguuuaaggagaugcucgccaauuucaccgaacaccauccgaucuuaauagcaaacaauaaaaagguucccuacgacuggacaauuuauuaccugcggaaaaaggcccuuacucagaagaucucaaaagaggaauuggcuuggauucugcuaaacuuuaaucagaagcgcggcuacuaucagcuccgaggcgaggaggaagagaccccuaacaaacugguggaauacuauagccuuaagguagagaaaguggaagauaguggggagagaaagggaaaagacacaugguacaauguccaccuggagaacgguaugaucuauaggcggaccuccaauaucccauuggauugggaaggcaagacuaaggaguucauugugacaaccgaccucgaagcagaugggucucccaaaaaggacaaagagggaaacauaaagcguagcuuucgcgccccuaaagacgaugacuggacgcugaucaagaagaaaacugaagcugauauugacaagaucaaaaugaccguuggcgccuacauauaugauacauuacugcaaaagccagaccagaaaauuagagguaagcucgugaggacuaucgagcggaaguacuacaaaaacgagcuuuaucagauccugaagacccaguccgaguuccacgaagaauugcgagauaaacaacuauacauugcgugccugaaugagcucuaucccaacaaugaaccucgcagaaacucaaucaguacaagggacuuuugucaucuguucauugaggauauaaucuuuuaccagcggccacuuaagagcaaaaagucucugauugacaauugcccguaugaggaaaaccgcuacaucgauaaggaguccggggaaaucaaacacgcaucaauuaaguguauagccaaaagccaucccuuguaucaggaguucagacucuggcaguucaucgucaaucugaggauuuaccguaaggagaccgacguggacguaacgcaagaauuacugccuacugaggcugauuacguuacacuauuugaauggcucaacgagaaaaaggaaaucgaccagaaagccuucuuuaaguauccacccuucggauuuaagaaaaccacaaguaauuaccgguggaacuauguggaggauaagccuuacccaugcaaugagacucacgcacagauuaucgcucgacugggcaaagcccacauacccaaggcguuccuuucuaaagaaaaggaggaaaccuuguggcauauccuguauuccauugaggacaagcaagaaaucgagaaagcccuccacagcuuugcaaacaagaauaaccugucggaggaguucauugaacaguuuaaaaauuucccgccuuuuaagaaagaauacggcucuuauuccgcuaaggccaucaagaaacuucugcccuugaugagaauggggaaguacuggucaauagagaacauugauaacggaacgaggauccgcauuaauaaaaucauagacggugaauacgaugagaacauccgggagagagucaggcagaaggcuauuaaucucaccgacaucacacauuuccgcgcccugccauuauggcuggcauguuaucuaguguacgaucgacacagugaagugaaagacauugucaaguggaagacuccuaaagauaucgaccucuaucuuaagagcuuuaaacagcauucccuucggaaccccauaguugagcaagugauuaccgaaacauugcguacuguaagagauaucuggcaacaggugggccacaucgacgagauucacaucgagcuggggagggaaaugaagaauccagccgacaaacgcgcucggaugucucagcagaugauuaagaacgagaauaccaaccucagaauaaaagcgcuguuaacagaauuucugaaucccgaguucggaaucgaaaacgucaggccuuacagcccaucacagcaggaucuuuugcgaauuuaugaggagggcgugcucaauaguauccuggaacuaccggaggacauugguaucauacuggggaaguuuaaccagaccgauacucucaagcgccccacgcgguccgaaauccugagauacaaacuuugguuggagcaaaaguauaggagcccuuacacaggcgaaaugauuccacugucuaaauuauucacccccgcauacgagaucgagcauauuaucccucagucacguuauuuugacgauagucucagcaauaagguuauaugcgaauccgagauuaacaaacugaaggaccgcucucuuggauacgaguucaucaagaaucaccauggcgaaaaaguggaacuggccuuugauaagccagucgagguguugucgguagaggcuuaugaaaaacucguucacgagagcuacucccacaaccggucaaagaugaaaaagcugcuaauggaagacauccccgaucaguucauugagagacagcugaacgacaguagguauauaucuaagguggucaaaagccuccuguccaauaucgugcgagaggaaaacgagcaagaagccauuucaaagaaugucaucccguguacugggggaauuaccgaucggcuuaaaaaggacugggguaucaacgauguguggaauaaaauaguuuugccucgcuuuaucagacugaacgaguuaacagaaagcaccagguucacuucuauuaauacaaacaauacgaugaucccauccaugccccucgagcugcagaagggcuuuaacaagaaacggauugaccaucgacaccaugcaauggacgccaucauaauugcuugcgccaauagaaacaucgugaauuaccuuaacaauguaagugcaagcaagaacaccaaaaucacucgcagggaucugcagacacuacucugucacaaggacaaaaccgauaacaaugggaacuauaagugggucauugacaagccuugggagacauucacucaagauacccugacggcguugcagaaaaucaccgugucuuuuaagcagaaucugcguguuauaaacaaaacaacuaaucauuaccagcacuacgaaaacggaaagaaaauuguguccaaucaaucaaagggcgacaguugggcuauccggaaaagcaugcacaaggagaccguccauggugaagugaacuuaagaaugauuaagacaguaucguucaaugaggcccucaaaaagccccaggcaaucguggaaauggaucugaaaaagaaaauacuugccaugcuggaguugggguaugacacuaagaggauuaagaacuacuuugaggaaaauaaagauaccuggcaggacaucaacccauccaagaucaaaguuuauuacuucacgaaggagacaaaagaucgcuauuucgcuguccgaaagccuauugacaccucuuuugacaagaaaaagaucaaagaaagcauuacugauacaggcauacagcaaaucaugcucagacaccuggagaccaaggacaaugaucccacucuagccuucucaccagacggaauugaugaaaugaaccggaauauccugauccuuaacaaaggcaagaagcaucagccgauuuacaaagugaggguguaugagaaggcagagaaauuuaccgucgggcagaagggaaauaaacgcacaaaguucguugaagcugccaaagguacgaaccucuuuuucgcgauauacgagaccgaagagaucgacaaggauacuaagaaagugauucguaagagaaguuacuccacaaucccucugaacgugguaauugagcggcagaaacaaggcuugucuagcgcccccgaagacgagaaugggaaccugccaaaguauaucuuaucccccaaugaucucgucuacgugccuacccaggaagagauaaacaaaggagaaguugugaugccaaucgacagggaucgcauuuauaagauggucgacucaagcggcaucacagcuaauuuuauucccgcaaguacugccaaccugaucuucgcucugccuaaggccaccgcagagauauacugcaauggugagaacugcauucagaaugaauaugggaucggcucuccgcaauccaaaaaccagaaggcgauuacgggagagauggugaaagaaaucuguuuuccaauaaagguugaucgacugggcaauaucauucagguggggagcugcaucuugacaaacuga

SEQ ID NO: 3437 - RNA, 4563 nt, Artificial Sequence
  Cas9 variant
augaagaaaaucgugggccuggaccucgggaccaacagcauuggaugggcccuuauaaaugcuuacaucgaugaguauaacaaggaacaccuguacgguauugaggcaugcggcuccagaaucauucccauggacgccgcgaucuuggggaauuucgauaaaggaaacucuauaucacagacagcugacaggacgaguuaucggggcauccgccgauuacgugaaagacaucugcuaaggcgggagcgccuccacagaauuuuggaucuucuggguuuucugccuaagcauuacagcgacucccucaauagguaugggaaauuccugaacgauaucgaauguaagcugccaugggucaaggacgagacuggaucuuacaaauuuauuuuccaagagucguuuaaggaaaugcucgccaauuucaccgagcaccauccgaucuuaauagcaaacaauaaaaagguucccuaugauuggacaauuuacuaccugcggaaaaaggcccuuacucagaagaucucaaaagaagaguuggcuuggauucugcuaaacuuuaaucagaagcgcggcuauuaccagcuccgaggcgaggaagaggaaaccccuaacaaacugguggaguauuacagccuuaagguagaaaaaguggaggacaguggggagagaaagggaaaagauacaugguauaauguccaccuggaaaacgguaugaucuacaggcggaccuccaauaucccauuggacugggagggcaagacuaaggaguucauugugacaaccgaucucgaagcagacgggucucccaaaaaggacaaagaaggaaacauaaagcguagcuuucgcgccccuaaagaugacgauuggacgcugaucaagaagaaaacugaggcugacauugauaagaucaaaaugaccguuggcgccuauauauacgacacauuacugcaaaagccagaucagaaaauuagagguaagcucgugaggacuaucgagcggaaguacuauaaaaacgaacuuuaccagauccugaagacccaguccgaguuccacgaagaguugcgagacaaacaacuauauauugcgugccugaaugaacucuaccccaacaaugagccucgcagaaacucaaucaguacaagggauuuuugucaucuguucauugaggacauaaucuuuuaucagcggccacuuaagagcaaaaagucucugauugauaauugcccguacgaagagaaccgcuauaucgacaaggaauccggggagaucaaacacgcaucaauuaaguguauagccaaaagccaucccuuguaccaggaguucagacucuggcaguucaucgucaaucugaggauuuaccguaaggaaaccgacguggauguaacgcaagaguuacugccuacugaagcugacuauguuacacuauuugaguggcucaacgagaaaaaggaaaucgaucagaaagccuucuuuaaguacccacccuucggauuuaagaaaaccacaaguaauuaucgguggaacuacguggaggacaagccuuauccaugcaaugaaacucacgcacagauuaucgcucgacugggcaaagcccacauacccaaggcguuccuuucuaaagagaaggaagagaccuuguggcauauccuguacuccauugaagauaagcaagagaucgagaaagcccuccacagcuuugcaaacaagaauaaccugucggaagaguucauugaacaguuuaaaaauuucccgccuuuuaagaaagaguauggcucuuacuccgcuaaggccaucaagaaacuucugcccuugaugagaauggggaaguacuggucaauagaaaacauugacaacggaacgaggauccgcauuaauaaaaucauagauggugaguaugacgagaacauccgggaaagagucaggcagaaggcuauuaaucucaccgauaucacacauuuccgcgcccugccauuauggcuggcauguuaccuaguguaugaccgacacagugaggugaaagauauugucaaguggaagaucccuaaagacauagaucucuaccuuaagagcuuuaaacagcauucccugcggaaccccauuguugaacaagugaucacugagaccuugcguacaguaagagacaucuggcaacaggugggccacauugacgagauccacauugaacuggggagggagaugaagaauccagccgauaaacgcgcucggaugucucagcagaugauaaagaacgaaaauacuaaccucagaaucaaagcgcuguuaaccgaguuccugaaucccgaguucggaauugaaaacgucaggccuuauagcccaucacagcaggaccuuuugcgaaucuacgaggaaggcgugcucaauaguauucuggagcuaccggaagauaucgguauaauccuggggaaguuuaaccagacagacacccucaagcgccccacucgguccgagauucugagauauaaacuuugguuggaacaaaaguacaggagcccuuacacgggcgagaugaucccacugucuaaauuauucacacccgcauaugagauugaacauaucauaccucagucacguuacuuugaugacagucucagcaauaagguuauuugcgaguccgaaaucaacaaacugaaggaucgcucucuuggauaugaguucaucaagaaucaccauggcgaaaaaguggagcuggccuuugacaagccagucgagguguugucgguagaggcuuacgaaaaacucguucacgaaagcuauucccacaaccggucaaagaugaaaaagcugcuaauggaggauauucccgaccaguucauagagagacagcugaacgauaguagguacaucucuaagguggucaaaagccuccuguccaauauugugcgagaagagaacgaacaagaggccaucucaaagaaugucauuccguguaccgggggaaucacugaccggcuuaaaaaggauugggguauaaacgacguguggaauaaaaucguuuugccucgcuuuauuagacugaacgaauuaaccgagagcacaagguucaccucuaucaauacuaacaauacaaugauuccauccaugccccucgagcugcagaagggcuuuaacaagaaacggaucgaccaucgacaccaugcaauggaugccauaauuaucgcuugcgccaauagaaacaucgugaauuaucuuaacaauguaagugcaagcaagaacacgaaaauuacccgcagggaccugcagacucuacucugucacaaggauaaaacagacaacaaugggaacuacaagugggucaucgauaagccuugggaaaccuucacacaagacacucugaccgcguugcagaaaauaacggugucuuuuaagcagaaucugcguguuauuaacaaaaccacaaaucauuaccagcacuaugagaacggaaagaaaaucguguccaaucaaucaaagggcgauaguugggcuauucggaaaagcaugcacaaggaaacuguccauggugaggugaacuuaagaaugaucaagaccguaucguucaaugaagcccucaaaaagccccacgcaauaguggagauggaccugaaaaagaaaauucuugccaugcuggaguugggguacgauacaaagaggaucaagaacuauuuugaagagaauaaagacacuuggcaggauaucaacccauccaagauuaaaguuuacuauuucaccaaggaaacgaaagaccgcuacuucgcuguccgaaagccuaucgacacaucuuuugauaagaaaaagauuaaagagagcauaaccgacacuggcauccagcagauuaugcucagacaucuggaaacaaaggauaaugaccccacccuagccuucucaccagauggaaucgacgagaugaaccggaauauccugauucuuaacaaaggcaagaagcaccaaccgauauauaaagugaggguguacgagaaggcagaaaaauuuacugucgggcagaagggaaauaaacgcaccaaguucguugaggcugccaaagguacaaaccucuuuuucgcgaucuacgaaacggaggagauugauaaggacaccaagaaagugauccguaagagaaguuauuccacuauuccucugaacgugguaaucgaacggcagaaacagggcuugucuagcgcccccgaggaugaaaaugggaaccugccaaaguacauauuaucccccaaugaccucgucuaugugccuacacaagaggaaaucaacaaaggagagguugugaugccaauugauagggaccgcaucuacaagauggucgauucaagcggcauuaccgcuaauuuuauccccgcaaguacagccaaccugauauucgcccuuccuaaggcuacugcagagauuuauugcaauggugaaaacugcauccagaaugaguacgggauuggcucuccgcaguccaaaaaccaaaaggcgaucaccggagaaauggugaaagagauauguuuuccaaucaagguugaccgacugggcaauauuauccagguggggagcugcauuuugacgaacuga

SEQ ID NO: 3438 - RNA, 4563 nt, Artificial Sequence
  Cas9 variant
augaagaaaaucgugggccuggaccucgggaccaacagcauuggaugggcccuuauaaaugcuuacaucgaugaguauaacaaggaacaccuguacgguauugaggcaugcggcuccagaaucauucccauggacgccgcgaucuuggggaauuucgauaaaggaaacucuauaucacagacagcugacaggacgaguuaucggggcauccgccgauuacgugaaagacaucugcuaaggcgggagcgccuccacaggauucuggaucuucuggguuucuugccuaagcauuacagcgacucccucaauagauaugggaaauuccugaacgauaucgaauguaagcugccaugggucaaggacgagacuggaucuuacaaauuuauuuuccaagagucguuuaaggaaaugcucgccaauuucaccgagcaccauccgaucuuaauagcaaacaauaaaaagguucccuaugauuggacaauuuacuaccugcggaaaaaggcccuuacucagaagaucucaaaagaagaguuggcuuggauucugcuaaacuuuaaucagaagcgcggcuauuaccagcuccgaggcgaggaagaggaaaccccuaacaaacugguggaguauuacagccuuaagguagaaaaaguggaggacaguggggagaagaaaggaaaggauacaugguauaauguccaccuggaaaacgguaugaucuacagaaggaccuccaauaucccauuggacugggagggcaagacuaaagaguucauugugacaaccgaucucgaagcagacgggucucccaagaaagacaaggaaggaaacauaaaacggagcuuucgugccccuaaggaugacgauuggacgcugaucaagaaaaagacugaggcugacauugauaaaaucaagaugaccguuggcgccuauauauacgacacauuacugcaaaaaccagaucagaagauucgcgguaagcucgugagaacuaucgagaggaaauacuauaagaacgaacuuuaccagauccugaaaacccaguccgaguuccacgaagaguugcgggacaagcaacuauauauugcgugccugaaugaacucuaccccaacaaugagccucgacgcaacucaaucaguacaagagauuuuugucaucuguucauugaggacauaaucuuuuaucagaggccacuuaaaagcaagaagucucugauugauaauugcccguacgaagagaaccgguauaucgacaaagaauccggggagaucaagcacgcaucaauuaaauguauagccaagagccaucccuuguaccaggaguuccgccucuggcaguucaucgucaaucugagaauuuacaggaaagaaaccgacguggauguaacgcaagaguuacugccuacugaagcugacuauguuacacuauuugaguggcucaacgaaaagaaagagaucgaucagaaggccuucuuuaaguacccacccuucggauuuaaaaagaccacaaguaauuaucguuggaacuacguggaggacaaaccuuauccaugcaaugaaacucacgcacagauuaucacccggcugggcaaggcucacauacccaaagccuuccuuucuaaggagaaggaagagacguuguggcauauccuguacuccauugaagauaaacaagagaucgagaaggcgcuccacagcuuugccaacaaaaauaaccugucggaagaguucauugaacaguuuaagaauuucccgccuuuuaaaaaggaguauggcucuuacuccgcaaaggcuaucaaaaagcugcugcccuugaugcgaauggggaaauacuggucaauaaagaacauugacaacggaaccagaaucaggauuaauaaaaucauagauggugaauaugacgagaacauccgcgagcgggucagacagaaggccauuaaucucacagauaucacucauuucagggcucugccauuauggcuggccuguuaccuaguguaugaccgccacagugaagugaaggauauugucaaauggaagaccccuaaagacaucgaucucuaccuuaagagcuuuaaacagcauucccuucgaaaccccauaguugagcaagugauuacagaaacuuugcggaccguacgugacaucuggcaacaggugggccacaucgacgagauucacaucgagcuggggagagaaaugaagucuccagcagauaaaagggcccgcaugagccagcagaugauuaagaaugagaacacaaaucuccggauaaaggcucuguuaaccgaauuucugaaccccgaguucggaaucgaaaaugucagaccuuauucaccaagucagcaggaccuuuugaggauuuacgaggagggcgugcucaacuccauccuggaacuaccggaggauauugguaucauacuggggaaauuuaaucagacugacacgcucaagcgacccacacgcagcgaaauccugcgguauaaacuuugguuggagcaaaaguacagaucuccuuacaccggcgaaaugauuccacugucaaaauuauucacucccgcguaugagaucgagcauauuaucccucagaguagguacuuugaugacagccucuccaacaagguuauaugcgaaucugagauuaauaagcugaaagaucguucgcuuggauaugaguucaucaagaaccaccauggcgaaaaaguggaacuggcauuugacaagccagucgagguguugagcguagaggccuacgaaaaacucguucacgaguccuauucacacaaucgcaguaagaugaagaaacugcuaauggaagauauccccgaccaguucauugagcggcagcugaacgauucuagauacauaagcaagguggucaaaucccuccugucaaacaucgugagggaggaaaaugagcaagaagcuauuagcaagaacgucaucccguguaccgggggaauuacagaccgacuuaaaaaggauugggguaucaaugacguguggaacaagauaguuuugccucgguuuauccgccugaaugaguuaaccgaaucuacuagauucacauccauuaacacgaauaacaccaugaucccaaguaugccccucgagcugcagaaaggcuuuaauaagaaaaggauugaccaucggcaccaugccauggaugcaaucauaauugccugcgcuaaccgaaauaucgugaacuaucuuaauaacguaagcgccucuaagaauacuaaaaucacaagacgcgaccugcagacccuacucugucacaaggauaagacagacaacaacgggaauuacaaaugggucauugauaagccuugggagacuuucacccaagacacgcugaccgcauugcagaaaaucacaguguccuuuaagcagaaccugaggguuauaaauaaaacuaccaaccauuaccagcacuaugaaaauggaaagaaaauugugucaaaccaaaguaagggcgauagcugggcgauccguaagucgaugcacaaagagacaguccauggugaagugaauuuacggaugauuaagacuguaucccucaacgaggcucugaaaaagccccaggccaucguggaaauggaccuuaaaaagaagauacuggcaauguuggagcucggguacgauaccaaaagaauuaagaauuauuucgaggaaaacaaagacacguggcaggauaucaauccaucuaagaucaaaguuuacuauuuuacaaaggagaccaaggacagguacuucgccguccgcaaaccuauugacacuagcuucgauaagaaaaagaucaaagaaucaauuacagacaccggcauacagcaaaucaugcugcgacaccuagagacuaaggauaacgaccccacccuggcuuuuaguccagauggaauugacgaaaugaauagaaacauccuuauccucaauaagggcaaaaagcaucagccgauuuauaaagugcggguguacgagaaggccgagaaauucacagucgggcagaagggaaacaaaaggacgaaguuuguugaagcagcuaaggguaccaaucuguucuuugccauauacgagacugaagagaucgauaaagacacaaagaaagugauucgcaagcguuccuauucuaccaucccuuugaacgugguaauugagagacagaaacaaggccugagcuccgcgcccgaagaugagaacgggaauuuaccaaaguacauccucucacccaacgaccuggucuaugugccuacacaggaagagauaaauaagggagaaguugugaugccaaucgaucgggacaggauuuacaaaauggucgauagcaguggcaucacugccaacuucauucccgcuucuaccgcaaaucuuaucuuugcccugccuaaggcuacggccgagauauauugcaacggugagaauugcauucagaacgaauacgggaucggcuccccgcaaagcaaaaaucagaaggcaauuacaggagagauggugaaagaaaucuguuucccaauaaagguugaccgcuugggcaacaucauucagguggggucgugcauccucaccaauuga

SEQ ID NO: 3439 - RNA, 4575 nt, Artificial Sequence
  Cas9 variant
augaacaagauccugggccucgaccuugggaccaauagcauuggaugggccauagugcagaaagaugagcaagguuucuacgaaaagaucauuaacgcuggcuccagaaucauucccauggacgcagagacaaugaauaacuuuaauaaagggaucacuaagucuccugccucagaaaggacgcgguuccgcggagcgcgacgucugauagagagaaguuuguuaaggcgggaacgcauccacagacugcuaaacaccaugaauuaucucccaccgcauuacgcugagaaaauugauuuugucaacaggcugggcaaguucaucggugaggaggaacccaaguaugccuacaaaguugacgaacacgggaaguuucaguucauuuuuaaagagagcuucaaugagaugcuuaaggauuuucaggacaaacagccugaacugguguugaacaauaagaagguaccauaugauuggacaaucuacuaucuccggaaaaaggcacugaaccgcgccauauccaaagaggaacugggauggauuauccuccaauucaauaacaagcgaggcuacuaccaguuaagaggcgaggaagacgagacucugaccgaggggcagaaaaaggaauauuuugcucuuaaagugauuagggucgaggcagauucuucgucagccggaaagaagggugaagugugguacaauguucaguuggagaacggcuggaucuaucggugcaaaagcgaaaucccccuggacugggaggggaagauuaaagaguucauagugacaaccgaagucgaugagaacgacaaugugcuaaaggauaaagaaggaaaggagaagcguaaacucaagaucccugaagcuggcgacuggacucugcuuaaaaagaaaacagagagugaccuggauaaguccgguaagaccguaggggccuacauuuaugacacguugcucucuaacccagaucagaaaaucaagggaggccugauacgcacuauugagagagaauuauacaggagcgagcuggaacaaauccucgacaaacagaaggaguuucaucccgagcuuaaagauggcacccuguauaauaaguguguugaagaguuguaccgguccaacgaaucacgacgcaucagucuaagcaauuacgacuucacaagauucauuacugaggaugugaucuuuuaucagaggccucugaagucuaaaaagucccucauugacaacugcucauucgaacggcgcaauuaccugaacccaauaaccaaagagcuugcguaugcaccgaucaaguguauugccaaaagccacccccuguuucaagaguucagauuguggcaguuuaucaagaaucucaggaucauugaacgugagaaaauagucggggauaagcugauguucgaccaggaugugacaaccgaauuuuuaccuacgcaaaacgacuacgugauccuguucgacuggcuaaaugagcauaaggaaauugaucagaaagcucuccugaaguauccagccuuuaaccuuaaaaagaauaucgacaaauaccgguggaacuaugucgagaauaagaguuaccccugcaacgagacucgagcauugcugaaggcuaaacucaacaaggccggaaauauuccuucugauuuccuggacaacgauacacuugaaucccuguggcacaucuuguacagcguugaggacaaauuugaaauagagaaggcgcucaaaucguucgccaccaagaaggaacugagagaggagcagacuguggcauuuguaaaacaguucaucaauauuccacccuucaagaaagaauaugguucuuacuccgcuaaggccaucaaaaaguuacugcaacuaaugaggaugggcucacgcuggagugagaacgaaauuagcgauuccacaaaggaccggauccagaaacucauagauggggagugggacgagucuauuaagaccagaacgagggauaaagcuaucaagcugaaugaaauuaacgacuuucagggacuuccguuguggcuggccagcuauaucguguacgaucgccacucagagaguggcgacgucaugaaaugggaaaccccugaggacauagauuauuaccucaagcauguguucaaacagcacggucugcgaaaucccaucguugaaguggucgugguagagacauuaaagguugugaaggaccuguggaaaacuuauggguacuuuaacgagauucauaucgaacuuggccgggagaugaagaauccagcagauaaacguagauccaugaccaacaagaauauugaaaacgagaauacaaacuugaggaucaaagcccuccuggcugaacuagcgaaucacaaggacgucgagggagugcgcccuuacagccccucucaacaggagauacugaagauuuaugaagagggcguccucgauaugcugacuaaagaagacccagauuacgagucaaucaguaagaucagcaaaauggcacuucccuccucuucggaauugauucgguauaaguguuggcuggagcagaaauacagaagcccuuauaccggacaggugaucccauuagcccgccucuucacauccgaguacgaaauugagcacauaaucccgcaaucacgauauuuugacgauaguuucucuaacaagguuauuugcgaaagcgcugugaacaaggacaaagauaaucugcuugccuacgaguacaucaagcagaacgagggaaaaauuaucgaaauaggucugggcaagaaaguaaaguuguuuaccgcagacuccuauacugaguucguccagucaaauuacguggggagcguugccaagaaaaagaaacuccugauggauacgauccccgacucuuuuauuaagcgccagcuaaacgacucccgguauaucaguagagaaauuaugaaacugcucagcucuguggucagggagaaggaagaggaggaagaggaagaggaagaggaggcuaucuccaagaaugugauaguauguacaggagccauuaccgauaaacugaagcgugaauggggccuuaacgacguguggaauacuaucaucuacccucgcuucgagcgguugaaccaacugaccaauucagauaaauuuggucagugggaaaacaagcaggggaaaaagguuuuccaaauugagaugccauuaaaacuccagaagggcuuuaauaagaaaagaauagaccauaggcaccaugcaauggaugcgaucgucauugcuugcgccacacagagucacgugaacuaucugaauaacgaaagcgcacauuccaauucgaaggagaaacgauacuaucuucggcgcaagcugagaaggaucgagauucuagaaaaacaggagcucaaggacggagugaccaucacuaagaaaauagaagucgccaaggaguucaacaaacccuggccuacauucacgcaagaugcucacgagguucugcagucuaucauugugagcuuuaagcagaacuugcgggugguaaauaaagccaccaaccgauacgcauguuucgucaauggcaagaaggaaaucgugaaacagucaaagggggagaguugggcuauuagaaaaccaaugcacaaggacacuguuuccgccgcggugucucugcgcaaaaucaagacagucagcuuaucccaagccauagaugacuggaccaacauuguggauaagucacucaggaaagaaaucggacugcuuuacagcaaguauggucagaauggcaguaaaaacaucauuaaguacuuuaaagaccgugacaauaagcauaacgggcuggauguuucuaaagugaauguacacuauuucgacaacgauuacgcugcaucccgggucgccuuggaccauaaguuuaauagcgcuaagaucaaaucgauaacagauacugggauucagaccauccuccugaagcaccuagagucauauaacgaaauuaauggcgacaaaaucauagagcaccccgagcuggccuucucugcagauggucuugacauucucaacgcgaauaucacgaagcugaacaaugggaaauuucauaagccgaucaagaaagugagaaagaccgaaacauugggccugaaauucauugugggacagacuggcaacaagaggaaaaaguacgucgaggccgcugaugggaccaacuuauuuuucgccaucuauguuaguguggacggaauuagguccuacaagacaauaccucuccgagaaguagcagagagacugaaagaaggccuuaucccagugcccgagaagaaugauaaagacgaucaccuguuguuuuggcucagcccuggugaccuggucuacgugcccucuauugaggaagaggggcggaucguugaaaucgagaacauuaagcaagacaggauauauaaaguggucagcugcacugaaaaugagugucauugcaucccacacuucguggcuuccccuauuguuaagaccgaugagcuaggagccaacaauaaggcacagcgcgccuggucaggcgaaaugaucaaagagacgugcauuaagaucaaaaugaaccgucugggucagauagugaagaucuga

SEQ ID NO: 3440 - RNA, 4581 nt, Artificial Sequence
  Cas9 variant
augaagaaaauccugggccucgaccuugggaccaacagcauuggaugggccgugcugaaugcugcagaugacaacuccuugaaguacauagaggccgcggguucuagaaucauucccauggaugcugccaucuuaggcgacuucgauaggggaaauucaauuagucagacagcagaacggacucgcauccgagggaugcgucaccugagagagagguaucuacuccggcgcgccagacugcauaggauacuuaaccuguugggcuuucucccuuuccacuacgcucaagacaucgaucgguaugguaauuuuagcgcagacauggaaccaaaaauugccuggcgcaagaaccuggagggggaacuggaguucaucuuuauugaguccuucaaugaaaugcucgaggauuuucgaaagaaccagccggaauuagucgcugacaauaaaaagguucccuacgauugggugaucuauuaccugaggaaaaaggcccuugagaaaaagauaucuaaagaggaauuggcguggauucugcuaaacuucaaucagaagagaggauauuaccagcuccggggcgaggacgaugacgaaucgaugaagacggcaaaaacccgucaauacuuugacaagcagaucauuaaaaacaucaucgauacaaaucagacuuauaagggccagcgcauucugauaguagagcuucaaaacggggacaaaggaaagaucuucaaaaaggaaauuccugauuggaucggucaggagaagaauauaauugugaccgucgacaucgauaaagacggcaacgauaaguacgaggaaucagggagccugaguugcagauuuaaaaucccaacagacgccgagugggaauccgaguggaaguugauuaaaaugaagacccagaaggaucucgacgaaucuaacaaaacugugggaacauauaucuacgauagcauucugcagaaucccacccaaaagguuaggggcaaauuagugcggacgauagagcgaaaguauuacaaagcugagcugaagcagauccucgaaaagcagacugaguuccauuccgaacuucaagacaaagaccuguauauugaguguuugaacgaacuauacucaaauaacgauacccaccgcaaugccaucacagacagagauuuugucuaccuguucaugaacgacauccucuucuaucagaggccucugaagaguaaaaagagccuuauugauaauugcccauacgagcggaacauauauaucgacaaagagacuggugaaauuaaguacucucccaucaaguguauugcaaaaucccauccucuguuucaggaguuccgcuuguggaaguuuaucucaagcauaagaaucuaucagagggaaagugugguagagguuguggauaaacaacucgaccuguucucuucccagagcaccucgguccagaaguuagugacagauguggacgucaccgauaaauuucugacgugcgagaaugacuacguugcucuauucgaauggcucaacaagaaaaagauuaucgaucagaaggaguuucugaaauaucguccauucgggcuuaagggagacauugacaauuaccgguggaacuacguggaagauaaaucuuauccguguaaugagacucacgccaugaucuugacauacuuugcgaaggccggcauauccgaagacauucugaccaaagagauggaggaagcacucuggcacauccuguauucaguagaggaucgacaagaaauuacuaaggcucuuagaacauucgccaguaaguaccaucugagcgacuccuuugugaaagucuucucuaacauacccccuuuuaagaaagaguauggcagcuacucagcuaaggccaucaaaaaguugcucagucugaugaggauggggaaguauugguccgaagaugcaaucgacgugaauacccgcgagcggauugauaaaaucguuacgggagaguacgacgaaaagauuagagauagggugcgcgagaaaaccauccgauuaaacgacauacggcacuuccgugcccugccagauuggcuagcuugcuacgucguguaugacagacauagcgaaacaagggagauuacugaauggaagucucccgaggagaucgaugaauacauccgcaacuucaaacagcacucacuccggaauccuauuguagagcagguuaucaccgaaacacugagaacugugagggacauuuggaagcaggucgguuguauagacgagauccacguggagcuuggccgagaaaugaagaacccagcggauaaacgcaagcggauuaccagucaaaucauugagaaugaaaacgcaaauuugagagucaaagcccugcucacagaguuugugaaccccgaguucgagaucgagaauguuaggccguauagccuggggcagcaggacauauuacguaucuacgaagauggagugcugaacuccguagcugaggucccuggcgacauugccgguauccuuaagaaauuuaaugaaaacgaugcaaagaaacgccccaccacuucugagauuuugcgguauaagcucuggcuggaacagaaguacagaucgccauauacgggggagaugaucccucuaagcaaacuguucacauccgccuacgagauagaacaugugauuccccaaucaagguacuuugacgauaguuucucuaauaagguuaucugcgaggcugaagugaacaaacucaaggacaaugcccugggcuaugaguuuaucaaaaagcaccauggagaaaaggucgagcuuggcuucgggaaaauuguggagauauuuagcguauccguguacgaacaguucguuaaggauaacuauucacgaaaucggggaaaaaugaagaaauugcugauggacgagaucccagaacaguuuauugagcgccaauuaaacgauagcagauacaucucuaaggucgugaagacccuccuguccaacguggucagggagaaagcagaacaggaggcgguuaguaagaaugugauuguguguacugguggcguaaccgaccggcuuaaaaaggacugggggaucaacgaugucuggaauaaaauagugcugccccgauucuugagacucaacgaacugacaaauagcaccaacuuuacugcuaagaaugccgcaggaaacgagaucccugccaugccacuagaacugcagaagggcuucaauaaaaagcgcauugaccacaggcaucacgcuauggaugccaucguuauugcaugcgcuaaccguaauaucgugaacuaucucaauaacgagucugccucccggaaagcgaagauaucaagacacgaccugcaggccauucuuugugauaaagucaggacagacgauaaggguaauuaccaauggcgcgugaagaaaccgugggacacguucacccaggauguuuauguggcuuuggagaacaucaucguaaguuuuaagcagaaccugcgagucauuaauaaaacuagcaacuacuacuggcauuaugaaaaugggaagaaaguguuagugaagcaggucaaaggcgacucgugggcaaucagaaagcccaugcacaaggauacaguuuucggagaggugaaccuccggaaaguaaaguccgugucucugaaugaagcccuuaaaaacccucaauuuauagucgagaaggaccugaaaaggcagcuacucagccuguugcagcagaauuucgauauuaagaagaucaaaaaguacuuugaagaacauaaagacauuuggucagacaucagucuguccaagaugaacauauauuacuucaccaaagagacaaaggaucgcuauuuugcuacucguaagccauuagacgccucuuucgauaaaaagaaaauugaaagcugcaucaccgacacgggcauccaacagauucuccugagacaccuugagcugaaggaaaaugaucccgagcgggcauuuuccccugacgggaucgaugaaaugaacaggaauauuauacaguugaacaaaggaaagggucaccauccaaucgcgaaggugcgcguuuacgagaaagccgacaaguucgaggugggccaacgagggaauaaaucaagcaaguuugucgaagcugccaaaggaaccaaccucuucuucgcaguguaugagacagaauaccccgaugagaagacuaauaguauuguuagaaaacggaacuacgcuaccaucccgcugaauaucgccauugagaggcagaagcgcggccuaucuacagcaccugaagacgagaaggguaacgugccauccuuuguccugagccccaacgaucuuguauaucucccuacuucggaagacauagugaaugggcacaucacccagcccauugauaaaucaagaaucuacaagaugguuucuaguuccggcagccagugcuucuuuauuaaacauaacaucgccaauauaaucguggacaaguaugaguucucuccacugaacaaaauggaaagggcuauuagcaaugagaugaucaaggagauuuguaucccugucaagguggaccgguugggaaacauaguaaaacugggcaaguccgaauga

SEQ ID NO: 3441 - RNA, 4581 nt, Artificial Sequence
  Cas9 variant
augaagaaaauccugggccucgaccuugggaccaacagcauuggaugggccgugcugaaugcugcagaugacaacuccuugaaguacauagaggccgcggguucuagaaucauucccauggaugcugccaucuuaggcgacuucgauaggggaaauucaauuagucagacagcagaacggacucgcauccgagggaugcgucaccugagagagagguaucuacuccggcgcgccagacugcauaggauacuuaaccuguugggcuuucucccuuuccacuacgcucaagacaucgaucgguaugguaauuuuagcgcagacauggaaccaaaaauugccuggugcaagaaccuggagggggaacuggaguucaucuuuauugaguccuucaaugaaaugcucgaggauuuucgcaaaaaccagccggaauuagucgcugacaauaagaagguucccuacgauugggugaucuauuaccugcgaaagaaggcccuugagaaaaagauaucuaaagaggaauuggcguggauucugcuaaacuucaaucagaagagaggauauuaccagcucaggggcgaggacgaugacgaaucgaugaagacggcaaaaacccggcaauacuuugacaagcagaucauuaaaaacaucaucgauacaaaucagacuuauaagggccagcguauucugauaguagagcuucaaaacggggacaaaggaaagaucuucaaaaaggaaauuccugauuggaucggucaggagaagaauauaauugugaccgucgacaucgauaaagacggcaacgauaaguacgaggaaucagggagccugaguugucgcuuuaaaaucccaacagacgccgagugggaauccgaguggaaguugauuaaaaugaagacccagaaggaucucgacgaaucuaacaaaacugugggaacauauaucuacgauagcauucugcagaaucccacccaaaagguuagaggcaaauuagugaggacgauagagcggaaguauuacaaagcugagcugaagcagauccucgaaaagcagacugaguuccauuccgaacuucaagacaaagaccuguauauugagugcuugaacgaacuauacucaaauaacgauacccaccgaaaugccaucacagaccgcgauuuugucuaccuguucaugaacgacauccucuucuaucagagaccucugaagaguaaaaagagccuuauugauaauuguccauacgagaggaacauauauaucgacaaagagacuggugaaauuaaguaccugcccaucaagugcauugcaaaaucucauccuuuguuucaggaguuccggcucuggaaguuuaucuccucaauacgcaucuaucagagagaaagcgugguagagguuguggauaaacaacuggacuuauucaguucucaguccaccagcguccagaagcuggugacagauguggacgucaccgauaaauuucuaacgugugagaaugacuacguugcucucuucgaauggcugaacaagaaaaagauuaucgaucagaaggaguuucuuaaauauaggccauucggguugaagggagacauugacaauuaccguuggaacuacguggaagauaaaucguauccgugcaaugagacucacgccaugauccugacauacuuugcgaaggccggcauaucugaagacauucucaccaaagagauggaggaagcacuguggcacauccuuuauuccguagaggaucggcaagaaauuacuaaggcucugcgaacauucgccucaaaguaccauuugagugacagcuuugugaaagucuucuccaacauacccccuuuuaagaaagaguauggcucuuacagcgcuaaggccaucaaaaagcuccugucauuaaugagaauggggaaguauuggagugaagaugcaaucgacgugaauaccagggagcgcauugauaaaaucguuacgggagaguacgacgaaaagauucgggauagagugagggagaaaaccauccgccugaacgacauacgacacuuccgggcccuaccagauuggcucgcuuguuacgucguguaugaccgucauuccgaaacaagagagauuacugaauggaaaagccccgaggagaucgaugaauacaucaggaacuucaaacagcacucucugcgcaauccuauuguagagcagguuaucaccgaaacacuucggacugugagagacauuuggaagcaggucgguugcauagacgagauccacguggaguugggcagggaaaugaagaacccagcggauaaacgaaagcgcauuaccucacaaaucauugagaaugaaaacgcaaaucugcgggucaaagcccuccugacagaguuugugaaccccgaguucgagaucgagaauguuagaccguauaguuuaagccagcaggacauacugaggaucuacgaagauggggugcuuaacuccguagcugaggucccuggagacauugccggcaucuugaagaaauuuaaugaaaacgaugcaaagaaacgucccaccacuucugagauucuccgcuauaagcuguggcuagaacagaaguaccggucgccauauacgggugagaugaucccucugagcaaacucuucacauccgccuacgagauagaacaugugauuccccaaucaagauacuuugacgauaguuucucuaauaagguuaucugugaggcugaagugaacaaacugaaggacaaugcccuuggguaugaguuuaucaaaaagcaccauggcgaaaaggucgaguugggauucggcaaaauuguggagauauuuagcguauccguguacgaacaguucguuaaggauaacuauucaaggaaucgagggaaaaugaagaaacuguuaauggacgagaucccagaacaguuuauugagcggcaacucaacgauagccgcuacaucucuaaggucgugaagacccugcuuuccaacguggucagagagaaagcagaacaggaggcgguuaguaagaaugugauugugugcacuggagguguaaccgacaggcugaaaaaggacuggggcaucaacgaugucuggaauaaaauaguguugccccgguuccuccgacugaacgaacuaacaaauagcaccaacuuuacugcuaagaaugccgcagggaacgagaucccugccaugccacuggaacuccagaagggauucaauaaaaagagaauugaccaccgccaucacgcuauggaugccaucguuauugcaugugcuaacaggaauaucgugaacuaucugaauaacgagucugccucccguaaagcgaagauaucacggcacgaccuucaggccauuuugugcgauaaagucagaacagacgauaagggcaauuaccaauggagggugaagaaaccgugggacacguucacccaggauguuuauguggcucuggagaacaucaucguaaguuuuaagcagaacuuacgcgucauuaauaaaacuagcaacuacuacuggcauuaugaaaaugguaagaaagugcucgugaagcaggucaaaggggacucgugggcaauccgaaagcccaugcacaaggauacaguuuucggcgaggugaaccugagaaaaguaaaguccgugucucuuaaugaagcccugaaaaacccucaauuuauagucgagaaggaccuaaaacggcagcuccugagcuugcugcagcagaauuucgauauuaagaagaucaaaaaguacuuugaagaacauaaagacauuuggucagacaucaguuuauccaagaugaacauauauuacuucaccaaagagacaaaggauagguauuuugcuacucgcaagccacucgacgccucuuucgauaaaaagaaaauugaaagcugcaucaccgacacgggaauccaacagauucugcuucgucaccuggaguugaaggaaaaugaucccgagagagcauuuuccccugacggcaucgaugaaaugaaccggaauauuauacagcucaacaaagggaagggacaccauccaaucgcgaaggugaggguuuacgagaaagccgacaaguucgaggugggucaacgcggcaauaaaucaagcaaguuugucgaagcugccaaagggaccaaccuguucuucgcaguguaugagacagaauaccccgaugagaagacuaauaguauuguucgaaaaagaaacuacgcuaccaucccgcuaaauaucgccauugagcggcagaagaggggacugucuacagcaccugaagacgagaagggcaacgugccauccuuuguccuuagccccaacgaucucguauaucugccuacuucggaagacauagugaauggucacaucacccagcccauugauaaaucacgcaucuacaagaugguuucuaguuccgggagccaguguuucuuuauuaaacauaacaucgccaauauaaucguggacaaguaugaguucucuccauugaacaaaauggaaagagcuauuagcaaugagaugaucaaggagauuugcaucccugucaagguggacaggcugggcaacauaguaaaauuaggaaaguccgaauga

SEQ ID NO: 3442 - RNA, 4584 nt, Artificial Sequence
  Cas9 variant
auggccaagauccugggccucgaccuugggaccaacagcauuggaugggcuauaguggagaaagaugguaaugacuucucccuggucgauaagggcguuagaaucuuuucugaaggggugaaaucagagaagggaauugaaaguagcagggcagccgagcggacaggcuaccgcuccgcgcgaaaaaucaaguaucguagaaaguugaggaaauacgaaacuuuaaagguacugucucuaaacgguaugugcccccucucgauugaggagguggaagaguggaaaaagucaggguucaaagaauauccucugaauccagaguuucuugaguggcugcggacgagcgacgaugaaaacaucaauccguacuucuuucgcgacaaggcuaguaagcagaaagucaccuuguucgaggugggcagagccuuuuaucacauagcacaaaggcggggauuccucuccaaccgccuggaucagucugccgaaggcauccuggaggaacauugucccaagauugaggcucucguugaggacuuaaauagcacagaugaaauccugacuucccuuaaagacuacuuuuucgauaccgggauuuuggacgcaaacgagaagggagguuuugccaaagaucuggacgaaggcgacaagaaacucgugucacucuaucgaaguauccaggcuauagucaagaagaaugauacagacuucgagaaagggaaggccgaaauuaucgagagacugaacaaaaaggaugugcuuggaaaaguaaagggcaagauuaaagacaucagccaggcgaugcuggaggguaauuuuaagaccuuggggcaauacuucuucucucucuacaacaaagaaaggauccggaaucaguauacuucccgugaggaucacuaccuggaagaguuuaagauuauaugcaaauuccagggaaucggcucaauuaaccagaaugaaaaguuaccugagaagaaauuugagggccuggcaaaggaacucuauaaagccaucuucuuucaacgcccacuuaagagccagaaagggcugauaggaaaguguaguuucgagaagucuaaauccagaugcgcuauuagccaucccgacuuugaagagaagaggaugugggaguacuugaacacaaucaaaaucgguacccagucggaaaagguucuacgguuccugucucaggaggaaaaacucaaccugauuccuaaguuucuucgaaagaaggauaauuucaacuuugaggaccuggccaaggaauugaucgagaaaggcgcaacguucggguuuuauaaguccucaaaacgcgauaguuuccacuacugguucaauuauaagccaacugacaccgugagcggaugucccgucuccgcuucucucaaaagcguggugggcgaggauuggaagacaaagucauuuauuuacaaaacuaccaacaguaaggguauagaagucuccagaacaguuaauuacaaagaccuguggcauuuacugagcgugucuaccucagacaucuaucuauacgaguaugccaagaacaaacucgggcuggaagauaagaaugcgaaggccuucaguaaaauuaaacuuaaaaaggacuuuggcaacuugagccugaaugcaaucaacaaaauccucccuuacaugagggagggacugcuuuauucccacgcuguauucauggccaauauugaaucuauaguggaugaggucaucuggaacgaccugggccaacggaaguacauucaggauaagaucgcugccauuaucgcaaauaacauaguggacaauggguugcucgagguugugaacggacugaucaaagaaugcaaggucgauggugccuauuacucgaaagaggcugcggacacguaccgcaaggauuuaagcaaaaagcugguguccuuuuucaaauuucaccauauugacgauggcaucaagcaggaaacuauucuaaacgagcuauucccaguauuuaucgaacaacugaaggcacacgaguucauaaaaguuaagagacuugacgagaaaguguuggaauuucugaagggggagaaucaggauggagaagucuucuguaacaaugccaaacagcucaagaagcuguaucauccgucagacauugagguguuuaaaaagcagaucgucaaagacaaggauggcacagagaccggucaauuaauucuggggaguccccuuacuucuagcaucaaaaacccuauggcuaugagggccuugcaccagcuccguaaggugcugaauacacuaauaguugaagaacagguggacuccucaacccggauccacauugagauggcacgagagcugaacgaugccaauaagagaaaaggcauccaggacuaccaaaacgaaaauaagaaagagagggagaaguaucgcgaugaaauuaaaaagcucuaccuggcugagugcaacaaggaaaucgagccaacgguagacgaucuuuugcgguaucagcuguggauagaacaggacagaaaagagauuuacgagaauggaaacagcaucucuaucugugauauuaucggcgacaaucccgccuaugauauugaacauaccgucccuagguccauaagucaggacaacagccaaaugaauaagacauuaugcucucagaaauucaaccgcgaugugaagaaacagaagaugccauucgagcucgggaaccaccuggaaauccuuccccgaauugcacauuggaaggaggaagcggacaaucugucccgggagaucgagaugauuauccguucaacuaaaaccgcugccacaaaggaagcaaaagacaagaaaauaagaaggcgccacuacuugacucuccggagagauuaccugcagggaaaguaugacagguuuaucuggaccgagccgaaaguugguuucaagaacagucaaauuccugauacaggcaucauuacccgauacgcccaggcuuaucuaaagagcuacuuuaaucgcguggaaucggucaaagggggaaugguggccgaguuccggaagaucuggggcauacaggaguccuaucaagaaaacgguaaaaaguacuuuaaagagaaggacagaucuaagcauacucaccacacgauugaugcaaucacaaucgcuuguaugaccaaagacaaguaugauguacuggcccaugcguggacucucgaagacaaagagcagauuaccgaagccaggaagauaguggcugagagcaaacccuggaagacauucaaggaggaucugaaaaagaucgaagaggggauucuuguuucacacuacaccccagacaaugucaaaaagcagaguaaaaagaucgugcgugugcgcggccggaagcaguacgucgcagaaauugagagagauguuaacggaaaagccguggcuaagaaagacaucuccggcaaggugauauauaaauuggacaaggaugggaaaaagcugccuagguuacaacagggagacacuauccgaggcucucuccaucaggauagcauuuacggugccaucaagaauccccugaaaacagaagagauucgguauguaauccgcaaggaccuugaguccauaaaagcaucagaugucgacaacauuguggaugaaaugguuaaggagaaagugaaggaagcgaucgccagcaagguccugauccuaaguucuaauccacagcagaaaaacaagauugacgggaaaguguggaugaaugaggaaaagggaauccccauaaacaaaguuagacucuacgcuaauuccgugaagaacccucuggagauuaaggagcacagcucguugucaaaaucuaggcacgaacauaagcaaaaaguauauggccagaaugaugagaacuuugccauggcaaucuacgaaggucuggacaagaaaggcaagacggagcgggcuuucgaguuaauuaacuauauggaugccggguacuacuauaagcucaaaaauaagaacgaacgaaagaaggacaucauaagucuggucccagagaaacacauugaaaccggauuuaaucuucugagauccaacaagaucccgaucauuuugaaaaagggccucaaugugauccuguacaagaacgagaaagaagagauugauuucaauaaccccaauagcauaaucaagcgccuauauaaaauuucugggcuggacaaggacggaaucaaacuuauguacugcaucagcgcaaagggcuccacugagaacauugccuauaugaaugaugugauaaacaagcagaaacucuuugaacugaagucagagauggaaaaauugggucugugggacaaggucuucagugauuucaaaaaugacaacuuaaagaaaagcgacuuuuucaaaaagcucaaugaucugcuuaacaaacauuacuuugagaauaacguuugcgauucuaucggguccauuaagaaagugaagaucaaggaaucaggacugacaaccccuaaaggcggugacguaauugauaacuucaaggacuuuccauauaucaaauucaaggugaguaauuuuaacgcuuugauagagggcaucgauuucaaaauuagccccacagggaaguuuguccaaaucuga

SEQ ID NO: 3443 - RNA, 4587 nt, Artificial Sequence
  Cas9 variant
augaagaaaauccugggccucgaccuugggaccaacagcauuggaugggcccugguggagcaggauuucaagaauaaacaagguaacauaaugggcaugggguccagagucauccccaugucucaggaaauuuugggagaguuugcuaggggcaauacaaagucagaaacugcagagcggacgcgcuuacgaaguguucguagacugagggaacggcaccuacuccgcagagagaggcugcaucgggugcuucacauccuggguuucuugccuaaacauuacguaaaccagauugacuuucaggagcgccucgggaaguucuuugaagagagcgaaccaaagcuggccuaugauaccggagacuuccuguuuaaaccguccuuccucgagauguuagaggaauuuaagauccaccaacccucuuucguggagggcgauaaaaaggucccuuacgacuggacaauauauuuucugcggaaaaaggcgcuuacugaaagaaucgagaaggaagaguuggcuugggugauucugucguucaaucagaaaaggggcuacuaucagcuacgaggggaggaugaagaggaaaagccaaacaaacucgaggaauuuuacucacugaagaucguugacauuaaaguggaugagagccccaauaagaaaggagacaccugguauagucuuacacuggagaacgguuggaucuaccgucgcuccucuaaggucccuuuggaugacuggcucggcaagaccagagauuucauagugacuacagacauugacgaagaggggaauccaaaacuggauaaggaaggaaaccccaaaaggagcuuccgggccccuuccgaggacgauuggggcuuacgaaagaaaaagaccgaaaaggagauccuggacucaaguaaaacgguaggucauuuuauuuucgagaaucuccuugcagauccaacucagaagaucaaagggcgccugguuagaaccaucgaaaggaaguuuuacaaagacgaguugaagcaaauucuagugagccagaaccgguuccacccggaacugucugaugccgacaugauggcugauugcguccgcgagcucuauaagcacaaucauucccaccagaacuuucuggcaucaaaagacauaaagcaucuucugguggaugacaucauuuucuaccagagacccuugaggagccaaaaaucaacaaucggaaauuguccucucgaguuuaagacuuucaaaaaggacggcauagaaauuaaggugccauauaaagucgcccccaagucucacccucuguuucaggaguuccguuuacugcaguggguuuccagccuacggaucauccgaaaaucggaugacucugaugugaccagagaauuucucggcacacaagacaagaccaaacagcugcuugauuacuugaugacgcaguccgagauggacugcaacaagcugaugacuuuccuccugacacaggaaggguauaaaaggaaggaucuuaagucagagguaggaaaauuucgcuggaacuacguguucgacagugagaccggugaaagcaagacuuauccaggcaauuccacacgggcugaguuccugaaaagauuggggaaggucgaaggauuugauuucucuaaauacaccgaggaauuugaggagagccucuggcaccugguguacucaguuacggacaagguggaauuugagaaggccuuaaggaaauuuagucgcaagaacggcauugaaaucaauuccuucgucgagaaccugaaaaaguuucccccguauaaaagcgaauacgcgucuuauucacuaaaggcaauuaagaaacuccuggcccuuaugcgauucggugagaauuggaaggaggauaguauagacagcaucuccaaacaucggauugaaaagaucuugaccggggaguacgauccugaaaucaaagacaaggugcgugagauuucuagagcuuuugacgagguagaagauuuccaaggccugcccguuugguuugccaacuauguggucuacggaaggcacucggaggcaagcgaacucauaaaguggacauccucagacgagauggcugauuucaucaaagaauuuaagcagcauagucugcgcaauccaauuguggagcaggucguguuagagacucugcggguugugaaagacaucugggauaaguauggccacgggcagaaagacuucuucgaugaaauucauguagagcuuggaagagaauugaagaacccugccgagcaaagggcgcgacucaccacacagaucucugccaaugaaaacacuaaucugcgcauaaaaagccuacuggucgagcuccugcacgaccccgguguggagaacguucggccauacucccccaugcagcaggaaauccuuaagauuuacgaggaaggcguguugaagaguagcuuugaggucccugaugacauccugaaaauuucuaagaccgcacaaccauccaguagcgauuuaaaaagauauaagcucuggcuggaacagaaauacaggucuccguauacagggaagaucauaccccuuaauaagcuguucaccccugcuuacgagguggagcacguaauuccacagucccguuauuuugacgauucauucaguaacaaagugaucugugaagccgcuguuaauaaguugaaagacaaccgccucggaauggaguuuauuaagugcuuccauggccagcgggucagccuggguuuuggggaagagguggagaucuucucggaauccgccuacaaagcauuuauacaagacaacuuccccaagaauccugccaagaaaagaaagcuacugauggaugagcucccagaacagaugguggagaggcagaugaacgacacucgauauaucucuaaauuugucacgagcauucugucaaauaucguucggagugaagagaacgauacaggcuucaauuccaagaacauuauccccggaaauggcaaaauaaccacugcucuuaagcaagacuggggguugaacgauguguggaaugagcugauuuuaccgcgcuucgaaagaaugaaccagcucaccggaacaaccguguuuacugcguggaaugagaaccaccagaaguuccugccuacaguaccacuugaauacgcaaaagguuuucagaagaaaaggaucgaccaucggcaccacgccauggaugcucuggucaucgccugugcaacgcgagaccaugugaauuaccuaaacaaugagcacgcccucggcaagaacuauaaagggaaggaagagaagcaaucuagacgcuucgaucugaggcagaaauugugccugaagaaaaagaacggacauagccaggagcaguacgaauggauuuucuccaaacccugggacucauucacccaagaugcuaagaaaaauuuagagcguaucauuguuagcuuuaagcagaaccuccgggugauaaauaagacaaguaacaaauaucugucuuacaaggacgaagagggcaaucuuagacuggacucccaggguaaaccugucaaggccuugacaaggcagaucaaaggggaugcaugggcgauucgcaagagcauccacaaggacaccgugucgggccucguuaaacugcgaagagugaagaugguaaaccuaucagucgcucuggauaaucccgaaaacauucuuaauaaaaagcucaaaaagaagaucgccgagcuggugaaauugaacuaugacaauaagcuguuacucaaauacuuccgggauagggacuauauguuugauggacgcgaggugucuaagcuggacgucuacuacuucgaagagggccuugcagccagucguguuucccuggauacuagcuuuucugacaaaaagauacaaagcaucacugauaccgggauuagaaagaucuugcucgcucaucuggccaacuaucacggacggcuagacgaaaaaggcaaggugauuccaccugagacgcuggcauucacccccgaggguaucgaggagcuuaauaaaaacauaaaggggcucaauggaggcaaauuucaccagccaauuuucaagguaaggacauacgaaccgaaagguaacaaguuccaggugggcuuuaaggggaacaaaaauuccaaguaugucgaggcugccaaaggaacuaaccuguucuuugcgaucuacuugaaugaugaaggcaagcgcucauaugagaccaucccuuucaacgugguuauggagcgauuaaaacaaggggaaggacccgugccacagacaaaugagaagggcgguaagcugcucuuucaucugagucccaacgaacuugucuacgugccugagacugacgaaaauuauaccaacguugacuucaaaaaucugagcaaggaacagguggagaaaauuuacaagauggucucuuccacggggucagaaugucacuuuguaagagccgauauaaguagcuugaucaaaggauacgacgcuaagacaaaggugggcgagcuagguucccugaacaaacaggaaguuaccaauaacggcaugacucggauuaaggagaaaugcuggaagaucaaaauugauaggcucgggucuaucuga

SEQ ID NO: 3444 - RNA, 4587 nt, Artificial Sequence
  Cas9 variant
augaagaaaauccugggcauugaccucgggaccaacagcauaggaugggccguggucaauuccuucgaugagaaccagaaugaagagucucuuaagcacaucgaaugcguugguucaagaauuauccccauggacgcugcaauucugggcgauuuugacaaagggaacaguaucagccaaacagccaagaggacugaguuccgguccgugcgccauuugcgagaacgucacuuacugagaagggcgcggcuacauaaaauacucucucugcuuggauuucugccugaucacuacguacaggacuuggauucgcauggcaauuucccagugaacgucgagccgaagaucgcuuggcgcaaggacucaaauggugccuuugaguucauuuuuaacgauagcuucgacgaaaugcuccaggauuuugcaacguaucagcccgagcugaucgccuguaauaaaaaggugccuuacgacuggaccauuuauuaccugagaaagaaggcucucacuaaaaaguuaaguaaggaggagcuguccuggauccuuuugaacuucaaucagaaaaggggguauuaccaacugcggggagaggaagaugacgagucuguuaagagcgcaaaaacacgccaguauuuugaccgacagaagauaaaauccauuguggauaccaaccaaacauacaagggccagaaaguccuaaucguggaacucgaggacggcauuaaggggaagaucuucaaaaaggaaaucccaaauuggguaggacaggagaaaucaauuauaguuaccaucgauauugacaaggaugguugcgacaaauacgaggaaaguggcgagcugagcuguagauuuaagauccccucugaugccgaaugggaguccgaauggaaacuuauaaaaaugaagacucagaaagaccuggaugcuucagggaagacagugggagccuauauuuacgacgcgaucuugcaaaacccuagccagaaaaucaggggcaagcucguccggaccauugagcguaaguauuacaaagaggaacugaagcagauccugaaaaagcaaguggaguuccacccagaauuacgcgauaaagaccucuuccuugacugccugaaugaguuguaucccaacaacgaugcacacagaaaugccugugcugacagggauuuuauuuaccuauucauggacgauauacuguuuuaucagcggccucucaagaguaagaaaucucugaucgccgacugcccauacgaaaagcauauguaccgagauaaagagacgggugagcuuaaguauuccagcgugaaauguauugcaaagucgcacccgcuguuccaggaauuucgcuuguggcauuucaucucuaacaucagaauuuaccagaaagagagggucguugacguggaugcugaccaauccgcccucucaagugcgcggagcgcccugaaguccaaguuagaagcagauguagacgugacuaaugaguuucugaccugcgaggcugauuaugucucucuauucgaauggcucaacaauaaaaagagcgugucacagaaagacuuucugaaguaccccgccuucgggaucaaaaagaguggagacaacuaucgcuggaauuacguugaggauaaguccuauccuuguaacgaaacaagagcucuuauauugagccaccuggagaaagccaauauuaggggcgacaucuuuacucgugaacaggaggaggcacucuggcacauucuguacucuguggaagaucgguacgagaucgucaaggcccuucagucauucgcugcgaaauaucgauuuaacgacgauuucgugaccguauucaguaaguuuccacccuucaaaaaggaauacggcagcuauuccgcaaaggccaucaaaaagcuguugccucucaugagaauggggaaauacuggucugaggcugccauagacauuaagacaagggaacgcaucgagaaaauuaucaccggagagugcgaugacucgauacgggaaagaguuaggcugaaggcaauucgcuuacaugauaucggugacuuucgagcccugccaguguggcuagcuuguuaugucguguacgaucggcacagcgaguccggcgacauuacgaaguggaaaacuccccaagaaauggauugguauauccagaauuucaagcagcauucacuccguaacccgauagucgaacaggugaucacagaaacccugagaguugugagggacauuuggaaacaaguagggcgcaucgacgagauucacgucgagcuuggacgggaaaugaagaauccugccgauaaaagagcaaagaugacugcgaggaugaucgagaacgaaaauacaaacuugcgaauaaaagcuaugcugaccgaguuucucaaccccgaguucgaaauugagaaugugcgcccauacagugccucucagcaggacauccugcggaucuacgaaaacggcguuuuaaauagcguguccgagauuccugaagagaucacggguauucugaagaaguuuaacgagagagaacagaggaaacgucccucaaccagcgagguccuucgcuauaaguuguggcucgaacaaaaauaccggucuccauauacagggaagaugauaccccugggcaaacuauucacuccugcauacgagaucgaacauauuaucccacaguccagauauuuugaugacaguuucaauaacaaggugauuugcgaggccgagguaaauaagcugaaaggaaaccuccugggcuacgaauuuaucaagaaacaccacgggaggcgaguggaucuuggauugggugagauaguugacaucuucagcgucgaugaauaugagaccuuugugaaggacuacuacucugcuaaucagcagaaaaugaagaagcuguuaauggaugaaauuccggagcaauucaucgagcggcagcucaacgacucccgcuauauuucaaaaguggucaagagucugcuuagcaauaucguuagagaacaggaugagcaagaaucgauauccaaaaaccugauugugugcacaggcggggugacugacagguugaagaaagacuggggaaucaaugauguauggaacaagcucauccugccccgguuccagcgacuaaauaacauuaccgagacaaccgaguuuacugccaagaacaugcagggccaugaaauaccugucgugccauucgaguaccagagagguuuuaauaaaaagcgcaucgaccacaggcaucacgcaauggaugcuauuguuaucgccugugcggggcguaacauugugaauuaucugaacaaugaaucugcccggaaaaaggcucaaaucagcagauacgaccuccagaggcugcuuugcgauaaagucaagacggacgauaacggcaauuauaaguggauauugaaaaagcccuggucaacacugacccaggacguguacgcagccuuagauaacguuaucgugaguuucaaacagaaucuccgcguaauuaacaagacuaauaaccacuauguccauuacgaggcuggcaaaaagaucauugccaaacaagaaaaggcauccugggcgauccgaaagccuaugcacaaagacaccguguuuggagaggugaaucugagaaaggucaaaacaguuucucuuaacgaggccauaaagagcccacauuguauugugcagaaagauuucaagaagaaacugcuaucccuccugaagcagaauuuugacgcuaaagaaguaaaggccuacuucgaggaacacaaagauguguggucagacaucaacuugagcaagaucgaggucuauuacuuuaccaaggacacuaaagaacgguucuuugcaacaaggaagccccuggauaguucuuucgaccgcaaaaagauugaguccgugacggauaccgggauccagaaaauauuacuccgucaucuggagcaaaagaacggagacagcgaucuugcuuucucgccggacgguauugaagagaugaaucagaacaucguucagcugaauggcgggagaaagcaccaaccuauugugaaaguccggguguaugaaaaggccgauaaauuugcaaucggacagcagggcaacaaggccucaaaauacguugaggcugcgaaggguacuaauuuguucuuugccguguaugaagaggaggucagggacaaaaagacaaacgcaguaauguucaagcgcaauuacgcuucuauaccacucaacguggccauugaucgacagaaaaaggggcugaguaccgcccccgaagacgagaauggcaacgcuccuaucuuuguucuaucccccaaugaucugguguaucuuccaacagcagaagacaucauuaacgccagaaucagcuucccuauuaauaaaaaccggauauacaagauggucucuugcacuggauaccaaugcuuuuucaucaaacaccauguggcgaauguaauuguggauaagaaggaguuuagcgcucucaacaaaauggagaaggccgaaaccaaugagaugaucaaagacaucuguguccccauuaagcuggacagguugggcaacauaguuaaaaucgggguguauaaguga

SEQ ID NO: 3445 - RNA, 4587 nt, Artificial Sequence
  Cas9 variant
augaagaaaauccugggccucgaccuugggaccaacagcauuggaugggccguggucaauuccuucgaugagaaccagaaugaagagucucugaagcacauagaaugcguugguucaagaaucauucccauggacgcugcaaucuugggcgauuuugacaaagggaacaguauuagccaaacagccaagaggacugaguuccgguccgugcgccauuuacgagaacgucaucugcuaagaagggcgcggcuccacaaaauccugucucuucugggauuuuugccugaucacuacguacaggaccucgauucgcauggcaauuucccagugaacgucgagccgaagauagcuuggcgcaaggacucaaauggugccuuugaguucaucuuuaacgauagcuucgacgaaaugcugcaggauuuugcaacguaucagcccgagcugauugccuguaauaaaaaggugccuuacgacuggaccaucuauuaccucaggaaaaaggcuuuaacuaaaaagcugaguaaggaggagcuuuccuggauuuugcugaacuucaaucagaaaagaggguauuaccaacuacggggagaggaagaugacgagucuguuaagagcgcaaaaacacgccaguauuuugaccgacagaagaucaaauccauaguggauaccaaccaaacauacaagggccagaaaguccucauuguggaacuggaggacggcaucaaggggaagauuuucaaaaaggaaaucccaaauuggguaggacaggagaaaucaaucauuguuaccauagauaucgacaaggaugguugcgacaaauacgaggaaaguggcgagcuuagcuguagauuuaagauucccucugaugccgaaugggaguccgaauggaagcugaucaaaaugaagacucagaaagacuuggaugcuucagggaagacagugggagccuauauauacgacgcgauucuccaaaacccuagccagaaaaucaggggcaagcugguccggaccaucgagcguaaguauuacaaagaggaauuaaagcagauucugaaaaagcaaguggaguuccacccagaacuccgcgauaaagaccuuuuccuggacugcuugaaugagcuauaucccaacaacgaugcacacagaaaugccugugcugacagggauuuuaucuaccuguucauggacgauauucucuuuuaucagcggccucugaagaguaagaaaucucuuauagccgacugcccauacgaaaagcauauguaccgagauaaagagacgggugagcugaaguauuccagcgugaaauguaucgcaaagucgcacccguuguuccaggaauuucgccucuggcauuucauuucuaacaucagaaucuaccagaaagagagggucguugacguggaugcuugccaacccgaccuguccucagcccggagugcguuaaagagcaagcuggaagccgauguagacgugacuaaugaguuucuaaccugugaggcagauuaugucucccucuucgaauggcugaacaauaaaaagucugugagccagaaagacuuucuuaaguacccugcuuucgggauuaaaaagucaggagacaacuaucgcuggaauuacguugaggauaagaguuauccaugcaacgaaacaagagccuugauacugucccaccucgagaaagcuaauaucaggggcgacauuuuuacucgugaacaggaggaggcccuguggcacauccuuuacagcguggaagaucgguacgagauugucaaggcacugcagucuuucgccgcuaaauaucgauuuaacgacgauuucgugaccguauucucaaaguuucccccuuucaaaaaggaauacggcaguuauagcgcgaaggcaaucaaaaaguugcucccacugaugagaauggggaaauacugguccgaggccgcuauagacaucaagacaagggaacgcauugagaaaaucauuaccggagagugugaugacucuauccgggaaagaguuagguuaaaggccauacgccugcaugauauuggugacuuucgagcacuacccguguggcucgccugcuaugucguguacgaucggcacucggagagcggcgacaucacgaaguggaaaacuccgcaagaaauggauugguauauucagaauuucaagcagcauucccugcguaacccuaucgucgaacaggugauaacagaaacccuuagaguugugagggacaucuggaaacaaguagggcgcauugacgagauccacgucgaguugggacgggaaaugaagaaucccgcugauaaaagagccaagaugacugcaaggaugauugagaacgaaaauacaaaccugcgaaucaaagcgaugcucaccgaguuucugaacccagaguucaagauagaaaaugugcgcccuuacucagcuagucagcaggacauuuuacggaucuacgagaacggcguucuuaauucugugagcgaaauccccgaggaaauuacggguauccugaagaaauuuaacgagagagagcagaggaagcguccauccaccucagaagucuugcgcuauaaacucuggcuggagcaaaaguaccggagccccuauacagggaaaaugauuccucuaggcaagcuguucacuccagccuacgaaauagagcauaucauuccgcagucuagauauuuugaugacuccuucaauaacaaggugaucugcgaagcagagguaaauaaacucaagggaaaccugcuuggcuacgaguuuauuaaaaagcaccacgggaggcgaguggauuugggacugggugaaaucguugacauauucagugucgaugaguaugaaaccuuugugaaagacuacuacagcgccaaucagcaaaagaugaagaaauuacucauggaugagauccccgaacaguucauugagcggcagcugaacgacucucgcuauaucuccaagguggucaaaucacuucugaguaauauuguuagagagcaggaugaacaagagagcaucucgaagaacuugauaguguguacaggcggggugacugacaggcucaaaaaggacuggggaauuaaugauguauggaacaagcugauccuaccucgguuccagcgacugaauaacaucaccgaaacaaccgaguuuacugcuaaaaacaugcagggccaugagauuccagucgugcccuucgaauaccagagagguuuuaauaagaaacgcauagaccacaggcaucacgccauggaugcaaucguuauugcuugcgccgggcguaacaucgugaauuaucucaacaaugaguccgcgcggaagaaagcccaaauuucuagauacgaccugcagaggcuuuugugugauaaggucaagacggacgauaacggcaauuauaaauggauccugaagaaaccuuggagcacauuaacccaggacguguacgcugcacucgauaacguuauagugucauucaagcagaaucugcgcguaaucaacaaaacuaauaaccacuauguccauuacgaagccggaaagaaaauuaucgcuaagcaagagaaggccaguugggcaauucgaaaaccaaugcacaaggacaccguguuuggcgaagugaaucuuagaaaagucaagacaguuucccugaacgaggcgaucaaaucuccccauugcauagugcagaaggauuucaagaaaaagcuacucagccuguugaaacagaauuuugacgccaaggagguaaaggcuuacuucgaggaacacaaagaugugugguccgacauuaaccugucaaagaucgaagucuauuacuuuaccaaagacacuaaggagcgguucuuugccacaaggaaaccguuagauagcaguuucgaccgcaagaaaaucgaaucugugacggauaccgggauucaaaagauccuccugcgucaucuugagcagaagaacggagacuccgaucuggcauucagcccugacgguauagaggaaaugaaucagaacauuguucaguugaauggcgggagaaaacaccaaccaaucgugaagguccggguguaugagaaagcugauaaguuugccauuggacagcagggcaacaaagcaucgaaguacguugaagccgcuaaagguacuaaucucuucuuugcgguguaugaggaagaggucagggacaagaagacaaacgccguaauguucaaacgcaauuacgcaucaaucccccugaacguggcuauagaucgacagaagaaagggcuaucuaccgccccugaggacgaaaauggcaacgcccccauuuuuguucugaguccaaaugaucuuguguaucucccuacagcugaggacaucaucaacgcaagaauuuccuuccccaucaauaagaaccggauuuacaaaauggucagcuguacuggauaccaaugcuuuuucauaaagcaccauguggccaauguaaucguggauaagaaagaauuuucugcgcugaacaagauggagaaagcugagaccaaugaaaugauuaaggacaucugugucccaaucaaauuggacaggcugggcaacauuguuaagauagggguguauaaguga

SEQ ID NO: 3446 - RNA, 4590 nt, Artificial Sequence
  Cas9 variant
augaagaaaauccugggccucgaccuugggaccaacagcauuggaugggccguggucaauuccuucgaugagaaccagaaugaagagucucugaagcacauagaaugcuuggguucaagaaucauucccauggacgcugcaaucuuaggcgauuuugacaaagggaacaguauuagccaaacagccaagaggacugaguuccggggaguucgccaucugcgagaacgucaccuacucagaagggcgcggcugcauaaaauccuucgccuguugggcuuucucccugaucacuacgugcaggaccuggauggucaugggaauuuccugguaaacguggagccaaagauagcuuggagaaaggacuccaauggaacguuugaguucaucuuuaacgauucuuucgacgaaaugcuccaggauuuugccaccuaucagccggaguuaauugcauguaauaggaaaguccccuacgacuggacaaucuauuaccugcggaagaaagcccuuacuaagaaauugucgaaggaggaacugucauggauucuacucaacuucaaucaaaagcgcggcuauuaccagcugcgaggcgaggaagaugacgagagcgugaaaaccgcuaagacaagacaguauuuugacaggcagaaaaucaagaguauaguugauaccaaccaaacuuacaaagggcagaaggugcuuauugucgaacuggaggacggagugaaagguaagaucuucaagaaagaaauuccuaauuggguaggccaggagaaguccaucaucguuacaguggauauugacaaagaugggugcgacaaguacgaggaaucuggagaguugagcugucgguuuaaaauaccauccgaugcagaaugggagucagaauggaagcucaucaagaugaaaacccagaaggaccuggaugccaguggcaaaacggucggugcuuauauuuacgacgccaucuuacaaaaccccagccagaagauacgugggaaacuggugcgcacuauugagagaaaguauuacaaggaggaacucaaacagauccuuaagaaacaaguggaguuccacccugaacugagggauaaggacuuguuccuagacugccugaaugagcucuauccaaacaacgaugcgcaccggaaugcaugugccgaccgagauuuuaucuaccuguucauggacgauauuuuguuuuaucagcgcccccugaaaucuaagaaguccuugaucgcugacugcccuuacgaaaaacauauguacagagauaaggagaccggagagcucaaauauucaagcgucaaguguauugccaaaagucacccacuguuccaggaauuuagguuauggcauuucauaucuaacauccggauuuaccagaaggagcgcguuaucgacguggaugcaugccaaccggaccuguccagcgcuagaucggcccuaaaaucuaagcucgaagcggauguagacgugacaaaugaguuucugacuugugaggccgauuaugucucccuuuucgaaugguugaacaauaagaaaucagugagucagaaggacuuucugaaauaccccgcauucggcaucaagaaaagcggcgacaacuauagguggaauuacguugaggauaaguccuauccuugcaacgaaacccgugcucucauucugucucaccuugagaaggccaauauacgaggggacaucuuuacacgggaacaggaggaggcucuguggcacauuuuguacagcguggaagauagauacgagaucgucaaagcccuccagucauucgcagccaaguauagguuuaacgacgauuucgugaccguauucaguaaauuuccacccuucaagaaagaauacggauccuauagcgcuaaggcgauuaagaaacuguuaccucugaugcgcauggguaaguacuggucugagucagcaaucgacauaaaaacgcgggaaagaaucgagaagauuaucacuggcgagugugaugacaguauuagggaacgcguucgacuaaaagccauccggcuccaugauauagagcacuuucgugcucugccaguguggcuugccugcuaugucguguacgacagacauagcgaauccggggauauuaugaaguggaagacaccccaagagauggacucuuauauccagaauuucaaacagcacucguugaggaacccgauugucgaacaggugaucaccgagacucugcgcguugugcgggauauauggaagcaaguaggaagaaucgacgagauucaugucgaacucggcagggagaugaaaaauccugcagacaagcgaaaagaaaugacaaagcgcaucauugagaacgagaauaccaaccugcggaucaaagccauguuaacggaauuucugaaccccgaguucgaaauagagaaugugagaccauacagcgcuucccagcaggauauucuuaggaucuacgaaaacgguguucuuaauucagugagugagaucccugaggaaauuaccgggauccucaagaaguuuaacgagcgugaacagcgcaaacggcccucuacaagcgagguccugagauauaagcuauggcuggaacaaaaauacugcuccccauauacuggcaagaugauuccccucggaaaacuguucaccccugccuacgagauagagcacgugaucccacagucaagguauuuugacgauagcuucaauaacaagguaauuugugaagcagaggugaauaaacuuaaaggcaacuugcugggguacgaauuuaucaagaaacaccauggacagcgaguugacuuaggucucggcgagauugucgauaucuucucuguggacgaauaugagacauuugugaaggauuacuacuccgggaaucaacagaaaaugaagaagcugcuuauggacgagauaccggaacaguucaucgagcggcagcugaacgauagucgcuauauuagcaaagucguuaagucuuugcucuccaauaucgugagagaacaagacgagcaggagucaauuaguaaaaacgugaucguaugcacuggaggcgucaccgauaggcugaagaaagacugggguauaaaugacguguggaacaagcuaauucugccccgguuccagcgacucaauaacaucacagaaaccacugaguuuacggcgaagaacauggaagggcacgagaucccuguugugccauucgaauaccagagaggcuuuaauaaaaagcgcauugaucauaggcaccacgcuauggacgccauagucaucgcaugugccagccguaacauugugaauuaucugaacaaugagucggcucggaaaaaggccagaaucuccagguacgaucuucaaaaauugcugugcgacaagguucgcacagaugacaacggaaauuauaaguggauuuuaaagaagcccuggggcacccucacucaggauguguacgcagcucuggacaacguaaucgucucuuucaaacagaaucuucgagugauaaacaagaccaaaaauuauuacgugcauuacgaggccgggaagaaaacaaucgcgaagcaggaaaagggaagcucaugggccauuagaaaaccuaugcacaaggauaccgucuuuggugagguuaaccugcggaaagugaagacuguaagucuaaaugaagcuaucaaaaacccacaauguauuguggagaaggacuucaagaaaaagcuccuguccuugcugaaacagaauuuugaugcaaagaaagucaaggccuauuucgaggaacauaaggacguguggucugauaucaacuuaagcaaaauagagguuuacuauuuuacaaaggacacgaaagaaagguucuuugcuacccgcaagccccucgacuccucauucgauaaaaaggagauugaaagcgugacugacacaggcauccagaagauccugcuucgucaccuggagcagaaaaacggggauccggacuuggccuucaguccugauggaauugaagagaugaaucauaacaucguccaacucaauggcgguagaaagcaccagccaauagugaaaguucggguguacgagaaggcagacaaauuugcgauugggcagcaaggcaacaagucuuccaaauaugucgaagccgcuaagggaaccaaucuguucuuugccguauacgaggaagaggugagggauaagaaaacaaacgcaguuaugcuaaagcgccacuaugcuagcaucccccugaauguggccauugaccgacagaaaaagggccuuucgacugcaccugaggaugaaaacgggaauguccccaucuucgugcucucaccaaacgaccugguauacuugccuaccgccgaggauauagcuaaugcgucuauuaguuuucccaucaacaaaaauagaaucuacaagaugguguccugcacgggaaaccgguguuucuuuauuaagcaucacgucgccaauguuaucguggacaaaagcgaguucucugugcugaacaagauugaaaaagcagaaaccgaugagaugauaaaggagaucugcgucccaauuaaaaucgacagguuaggcaauaucgugaagauugguguuuauaaguga

SEQ ID NO: 3447 - RNA, 4608 nt, Artificial Sequence
  Cas9 variant
augaacaccauccugggccucgaccuugggacaaauagcauuggaugggcccugauaaagguguugaacgauaaaacuagauuaccccuggagaucauugaccuaggugucguugugaucccuacggaucagaggacccucgacaaguucuccaaaggcgaaucuauuucaaagacagcugagcggacuaaacaaaaggggguacgcaagcuguacgaacgaaagaaacuucguagagagaggcugcaccggguguugaauauccucggauuucugccagaacauuauaguaaaaagauagauuucaaaaagcaccugggccaguuuuucgguaacagccagccgaagaucuccuacgucgagaaugaccaugggaaacacgaguuuauuuucauggauucuuaucgcgaaaugcucaaggaguuuucgaaacauaacaucaagaaugugcccuacgacuggaccauuuauuacuuaagaaagaaggcacugucacagaaaaucagcaaggaggaacuugccuggguuauauugaacuucaauaagaaaaggggauauuaccaauuucgggaugacaacgcggaugagaauaaggaaaacaaaauugagaaguacuaugcucugaaagugacaaaugucaagaaggaagacgcccagaacuacaccaucacucuagagaauggcuggauuuauaaaaacaagaguaaaaucucccuccuggauugggugggcucuacaaaggaguucaucagcaccgaaaaauuugacaacaaggggaauauuauaaagaaaaagaacggagaggacgaucgcacgcuuaaacugguagacuccgaaaaggauuggaucgcaauuaaaaagucaacugaggaccgaaucgaaaauuacgguaagaccguuggcacauauuuguacgagcaccuccugaaagauccuaaccagaaguuaaauggggaacugauaaacauuaucgacagaaaauucuauaagaaugagcucaaacagauccuugagaagcaaaaagaauuucacccagagcuguugaacgaagaucuauuccagaagaguauuaucgagcuguaccccaagaauagcacuaggcagaaagaacucaagaacaaagaccugugcuaccuucugauugaugacgugauauauuaccagcgggauuugaagaaaaagaacucuaccaucaauaaguguuccuucgagucacgugaguauuaccucaauggagaaaaacaaauucagaagaucaacugcaucgccaaaagcaagccucuguaucaggaguuucgcacauuacaauucauuaaaaaucugaaggucuacgaaauaaucgacggccuagagaaggacauuaccaguaaacuccugccagauuuugagacgaaggaacauuucuuugaguggcuuaacgacaaagaaaagaucgaucaguugcagcugcucucuuauaaauguuucgaccugcacgauaacgugaagaaugaccuuauugcuaaggguaucaaaagacccacugagaaggcaauaaggacagaacuguuggagaaauaccgguggaacuacuccaaggauaaugaccgaaacuuucuccugaaugagacccgcuucaaaaucuuaaaguaucugaaaaagguggauaagaaacuaacucucacaaacgaacagauugagagccuguggcuuuugcuguacucggccaaggacgaaagagagcucaaaaaugggcugcaaaaguuuucugaaaagaacaaguuaccuaagaaauucuccgauaucuuuauuucauucccaccguuuaagaaagaguauggagcuuacagugagaaggcccugaaaaaguugcuuagccucgucagguucggcaaguauugguccuucaauaaaaucgacaacaauauacagaacaagauuaugaauauccugaacggcgaaguugaugacucuauuagcgaccgggugcgcgagaaaaccauccuacugcaggauaagaaugacuuucaggaucucccccuguggcuugcgucauacguagcauauaacagauucagugaaguguccgagauaaaauacugggacagcccugauaagaucgaauuuuugaagcaacauucuauugggaacccaaucgucgagaaaauuaucaaugagacgcugaaguuaauaaaagacauuugggugauccacggaaagucaugcaaaaacuucuuuagugaaauccacauugagcucagcagggaaaucaaguccucuucgaagaaacgugcccagauuaccaauaacaauacaaagaaccagaaacugaauaaccuuauaaagagccuguugaucgagauggcuuccgauacuaaauacgagaauguuacccccuauucaccuagucagcaagaaauucucaagaucuacgacgaggguauuuauucuaaagaagagaacagcgaaaagaucaaggagauaaauaaaauccggaacaauaacaagauuuccaaaucagauaucacaaaguacaaacuguggcuagagcagggcuauauuagcccauacacugggaagaucauaccccugaccaaacucuucacagccaaauaucagaaggaacauauuaucccgcagaccaaauuuuucgacgauucuuuuaauaacaaggugaucugugaggcagaagucaacaaacugaaggacaauucccuugcuaugaacuucauuaaggccaaaggaggcaaggcggugaaauugagugauggugagacuguaacgauacugaaucaagaagaguacaagcaguuaguucgaaccagcuuuaaaaagaacucuaucaagcucagaaaucugcuucuggaggaaauuccugacacauucacuaaaaggcagcuaaacgacaccaaguacaucuccaaacucgugcugucauugcugaguaauauuguccgcgagaagggggaauuagagagcacagccaaacggaucgugucgaccaacggccaaauaacuuccauccucagaaaugauuggggacugaacaauauuuggaacaaacuuaucacacccagguuugaacgccugaauaacauuaauaaaaacaagaucuauggcaauugggagaacaagaaagggaagaacgucuuccagauaaauuacuugaacgacaaucucucuacgcugaacaccaaacgaauugaucaccggcaucacgcacuagacgcucugaucguggccugcacuacacguaaucauaucaacuuccuuaauaaccaguaugcuaagagcagaaaucagaggcacgaucuccgcgccaaacugaagcggagagagaccauuacaacugaaggaucaaagaaacaaguuuuuaaggacuucaucaaaccaugggagaguuuuacccaggaugcauugaagaaacuggaaacgaccauagugaacuucaagguaaauaagaggauuaucaacaaaacaauuaauugguacaagaaaugggagaagcagaaagacgguacuuauaagaagauccagaaaaagcaaaccaaaggcgaugccugggcuauacgaaagccuuuacacauugacacaaucuacgggaucgucuguaaaaagcucccccugaaauccgcgcuugagaacuauaagaauauuaucgaugaaaaccugaagcauaaaauuaaggaguugaaagaagugaacaaguuugacaauaaccagauaaucaauuucuuuaaagagugcaacuucauuuuugaagacaauaacauccagaagguugagguguacgauuucaaggacaaucgcgauaaaacuauccucucuagcucccggcagcugauugacgagucauuuaccccaaagaaaauaggaaagguccuagaucccacgaucagaaacauucugcuuaaacaccucaauagcacaaaguacaacaauaaguucgacagugauggcaacccuaucaaaccagaaaagcuggcauucucuccggaggguuugaaagacuuaaauaagaacauuaaacaucugaauaacaacaaggaacaccaacccaucaagagggugaaacucuuugagacccuggggaauaagauaaaaguaggcuauacucagcagaagaacaaaaaguucgccgaaacagcuaccggaacuaaucuuuuucugggcaucuacuccgauaacaauaagcgugacuucaaaaccauuccuuugauccuagccauucaacgcgagaaggaggggcugaacccaugucccgauacagacgaaaaaggaaaucagcuccuguuuagccuuucgccuaacgaguuaguguucguuccaaauaacgaggaacggaagaaucccaaccuggucgauuuugaaaaucucucaaaagaccagaucgacagaauauauaaguucgugucuugcacggguagugaggcauacuuugugccguccaggaccgccaaaccuauuaucgagaacgaaaauggcacuaacaacaagagccagcgaauuaucgaguucaaugaaaagacaucuaucaaaaacgagaagaaugagccagucuugauaaaaaccauuuguuggaagaucgaaguuaaccggcuggggaaaauuaucaaggugauaaaguga

SEQ ID NO: 3448 - RNA, 4608 nt, Artificial Sequence
  Cas9 variant
augaccaagauccugggccucgaccuugggacaaacagcauuggaugggccauaagagauacugagaaugaagguaucaaccagauucuggacaaaggcgcuaggaucuucuccgagggggugaagucugaaaauggaaaagagauuucacgggcagccgaacgcacggcguaccgaagugcucguaagaucaaauauagaaggaaguugcggaaguacgagaccuuaaaaguccugagcauaaacggcaugugcccccuauccguugaggaaguggagcaauggaagaaaucugguuuuaaggaauauccucucaauccagaguuccuggauuggcuucgcacaaacgaggacaaaaauaucaacccguaccuguuuagagauaaggccucgaagcagaaaguaacuuuguucgaacucgggagggcacuguaucacauugcccagcggcgcggauuucugucaaaucgacucgaccagagcgcugagggcguguucgaggaacauaacccccaaauccagaauuuaauugaagaucuggacaguuccaacaccauccuuaaugaguugaaggaguacuauauaaaccugggcauuaucgaugaaacagagaaaucuggguuuaagaaagaccuagaugaaggagagaagaaacucaagagccuguacaauucccuugucgcaauuaccaagaaaaacgccaacgacaucgaaacuuguaagcaggagcugaucgcuagauugaauaaaaaggaggaucucgguaaagugaagggcaagauuaaagacauaucacaggccaugcuggacaggaacuucaagacauuagggcaauacuuuuucagucuguauaauaaagaacggauccguaaccaguacaccagccgcgaggaacacuaucucgaggaauuuauuaucauaugccagacgcagggaauugagggcaucaauacuaacgagaaacuuccugaaaagaaguucaccggucuggcgaaggauuuguacagagcaaucuuuuuccaaaggccacuaaaaucucagaaggggcugauuggaaaauguuccuucgagaagaauaaaucacggugcgccguuagccaucccgacuaugaagaguuucgaauguggaguuaccucaacacaaucaagauuggcacucagucugagaagacccugcgcuuccuuacacuggaagagaaauugaagcucgugccuaaauuuuauagaaaguccgauuucaauuuugaaguccuggcuaaagaguuaguggaaaagggcgccagcuucggguacuacaaaucgucuaagaagaacgaguuuuucuauugguuuaauuacaaaccaaccgacuccguaucagcauguguugugagugcuagccuggagaacgccauaggaaaggauuggaaaaucaagacguucgaauaucaaacuaggaauacagagaaaaacgaagucaccaaguccguggacuacaaggaucuauggcaccuccugucuguggcgacuagcgacacauaucuuuacgauuuugccauugagaaauugaagcuggaacccaaaaaugcaaaggcuuucucaaaaaccaagcucaagaaagacuuugccagucugucccuugcugccaucgcaaagauccugccuuauuugaaacagggucuccuguacagccaugccgucuucauggcuaacauugagaacauaguugaugcggacaucuggaaggacgaggaacagcagaaauucauucaaucuaagaucguggaguuaguagauaauuacauuguggaaaagucaaaacuggagcuaaucaacggccuccugaagauauauaauacggaagacaaagaggggcggaaggucuacuauaguaaagaggcagaaagccuuuuugaggccgauuugcgcaagaaacuggugccauucuacaaggcuaacaucauuaucgaggaacacgagcaggaaauuaucuuucaggaccucuucccgauacugauggaucaguuaaagaaacaagaguuuauuaagaucggaagacuggacaaacagauugaagccuuccuugagggcgaaaaugaggagggucagaucuuuugcaaccacaccgauaaguugaaaaagcucuaucaucccuccgacauagaaguuuucaagaaaaagacaaucaaagaugagugggggaaugaaaaggugguccugggcucuccucuaacuaccucgauuaaaaacccaauggcaaugagggcccugcaccagcuccguaaggugcugaauacacuuaucgcuaacgaccaaauugaugaggacacucggauccauauagaaauggcccgagaguugaaugaugcaaacaagagaaaaggaauacaggacuuucagaaugagaacaagaaauucagggaagaggcgaucaaggaaaucaaaaagcuguacuuagaggaaugucacaaggacguaaaucccaccgaggaugacauucuccgcuaucagcuguggcuugagcaaggcaaaugcgaaaucuacgaggaagggaacaacauuagcauaugugauaucauuggauccaauccuucauacgacaucgagcacacaauuccacggaguaucucucaggauaacagccagaugaauaagacccugugcuccuugaaauuuaacagaucaauaaagaaacaaaagaugcccguugagcucagcaauuauaacgacauccugccgaggauugcucauuggaagaaagaagccgaggaacuaacucgccagaucgagacgauuucucgauccaucaagagugcagccacaaaaguggcuaaggauaaaaauauacggaagcgucacuaccugacccucaaaagagacuauauucuggguaaguacgaaagguucacuugggaggagccuaaggucggcuuuaaaaacagccagauccccgauaccgggaucauuacaaaguaugcccaggcauaccuuaaaucuuauuucaagcgcguggaauccgucaaaggaggcgcuguggccgaguuccggaaguugugggguauacaagaaucauuuaucgacgagaauugguggaagcauuacaaagauaaggacagagauaaacacacccaucacacuauugacgcgaucacaauugccuguaugccaaaggacaaauacgaucuguuagcucacgcauggaggcucgaagacgagcaggauaagaaggccgcuaaaguucugaucgagcaggccaagccuuggaaaacguucaaggaagacauagagaaaaucgaaaccgagauucuugugagucauuuuacucccgauaacguaaagaagcagagcaaaucgaucauuaagaaucgagggaaaaaggucuaugugcugaaaaacgaacuaccaguuaauuucaagaacaaaaucgagggcaaggacuacuuuaagcucaaauucgauuccaagauacuguauaaaauucccaagaaaaaggagaagcaaacagacaccuuuuacgaagaguugccuaaaaauuaucugaacggaguggaaggcaaggauuacuucaaaaucaacacaacugggaagaccuuuuauaaaaucccaauuuucaaucagggagacacgauccgcgguucuuuacaccaggagaccacauacggcgcaauaaagcucccggauauugacaucgagacuaagaaaccccugcauaccgacaaagggggauuuauucuuaaaaaggauaucaaaggcaacgaaauagucuucuucgugguacggaaggagauuagcaagaucucagaaaaugacgugcagaacaucguugauaaugucgugagaaagaagauugagaacgcgaucgccaauagucugauuacauuuaaaauagugaagaaaaagaaagucgcuguuaucaaggaaggugugacuauuuggaugagggagccuaacaucgagaaggggaucgaaggcauuccaauuaaaaaggugcguaucauuaccaauuccgucaaaaaccccaucgagauuaagguacacucuccuuugagcaaaucccgccacaagcauaagcaaaaaguguacggacagaaugacgaaaacuaugccauggcacucuacgagcuggauggcaagcgggaguucgaacuaaucaauaacuuuaaucuggcuaaacuucucaagcagucacaaagcuauuacccacugcacaaagagaaggaaauaaaggggaaaaagaucuugguucccauugagaaaagaaacaauaaggacgugauccugaaaaggggacagcaggucguguucuaugauaagacgguugaaaacccgaaggacauuagugagaucauagauuuucgagaacggauuuacaucauugagggcuuaacaauccagcgccaaaaagacaagaaaaccucuaaggugaacgaguaugguauaauccagcucagacauuucaaagaagccaggaaguccgaggaaauuagcaaggauaauuuuaaaccugacggggaguucaagaucaacgagaauaaaccaacucggaagaugaaccacaaucaguuuacagcauucguagaaggaauugauuuuaaaguccugcccucgggcaaguuccagaaaaucuga

SEQ ID NO: 3449 - RNA, 4614 nt, Artificial Sequence
  Cas9 variant
augaagaaaauccugggccucgaccuugggaccaacagcauuggaugggcccugacaacuaaugauuucgacacgaagaaagguaccauagagggcuugggguccagaaucauucccaugucucaggauaucuuaggaaaguuugacucaggcgugagucugagccaaacagcucagaggacugaauaccgggguaaacgccgucuaguccagcgauuccuccugagaagggagcggcuucaccgcguucugcauauuuuggaacuccugccuaagcaguauuccgaggcaaucgauuuugacaagaaacuggggcaauucaagccagaaagagagcagaaaauaucuuuuuacaagaacgagucgggcaaaaaucaguucaucuuuaccaagucacaccaggaaaugcucacagaguuccaaaccuauuacccgacuauuaagaacauccccuaugauuggacaauuuacuauuuaaggaaaaaggcccugaccgagaaaaucagcaaggaggagcuugcguggauauugcugaauuuuaaccagaaacggggauacuaccagcuacgcggcgaagagaaggaagagaauaaaaacaagaaggaagaguuccauacgcuccuggugacugacauuaucgagcgagauaaagggaagaguggaaccugguauaauguaauucuugaaaacgguuggaucuacaaaagagaguccaagaucucucuggcugacuggauuggcaaaacaaagagcuuuauagugacuaccgaauauaaugaugacggguccgucaaguugacaaaagauaacgaggaaaagaggucauuccggaguccuaaagaggacgacuggggacucaucaagauucguaccgagaaaacgaucaaucagagcgauaagucugugggcgccuacauauaugacgcacuguuaaagaacccaaaucagaaaauuaagggugaacugguucgcacuaucgagagaaaauacuauaaggaugaacucagggagauccuuaaaaagcaacuggaauuucacuccgacguguugaacgauaagauucuauacaaaaagugcaucgacgagcuguacaaaaacaaugauucacauaagaacagcauuaaagaccggggguucgauuaucucuuccuggacgauauaaucuuuuaccagcgaccccuuaagaguaaaacaucucugauuuccgacuguagcuuggaguuccgcccuaucaagaauaagaacggaguccucgugaaagacaccgauggcaagcaaaucgccaaagcucugaagugcauugcaagaucgaauccaauauuucaggaguucagguuacugcaguuuguuaaaaaccuaaagaucuauaagcggggcguaguggacgaugucgaggugacuaaugacuaccucaaaucugaaaacgauguggagaagcuguucaauuggcuuaacgacaaagccgagauuaaucagaagcaauuuuuggucaacuucaaacugaaggaagauaagcaccgcuggaauuuuguugaggacaaaggguaucccuguaacgaaacaagaaaucaguuccucaacgcuaucgccaagauugauguggacaaauccuuuuucaacaccaagaauacgcaggaucuguggcacauccuuuacucaguaaccgacaaaauagagaucacaaaggcgauuacuaccuuugcaaagaggcauaaccugccuaaugaguucaucauuaacuucaguaaaaucaagccauauaaaaaggaauacgguagcuuuuccgagaaagccauaaagaaauugcucccgcugaugcguuucggaucuuacugggaugcuaagaauauugacaucaagacauuagaccggauugauaaaauccagacuggcgaauuugacgagaagauacgaaacagagugagggaaaaagccaucgaucugcacaagauugacgauuucaaagaccuaccccucuggcuggcaagcuauaucgucuacgauaagcauucagaggcuagugacguguccaaguggaaaaccccugccgauauugaaaaguuucuuaaacacgaguucaagcaacacagcuugcgcaauccaaucguugaacaggugauaacagaaacccugcgggucgugaaagacauuuggcuccaguauggggagggaaaggaaaacuuuuucaaugagauccauaucgaacugggcagagagaugaagaacgauaaagcgacuagggagaagauuucuaaaaagguaucagaaaaugagaacacgaauuuacgcaucaaagccauucugacagaacuuaagaacgacgguguuagugauauacgacccuacagcccuucccagcaagagaucuugaagauuuaugaggaagggguguacaauaacgagucucggaaagaaaagcucgaggaagucgacaaaauccguaagaacgcaaaaccaaccacuucggagauuaucaaguauaagcuguggcuagagcagggcuacgcuagccccuacaccggaaaacugauaccgauguccgaacucuuuacaaccaaguaucagaucgagcacauuaucccucagucaagauucuuugacgauagucugucuaauaaagugauuugcgaaagcgaggucaacgaacuuaaguccaauaugacugccuuggaguucauccugacaaacgagaauaggauagugacguuaaccggcggggaaacuguuaaaauuuuuacaaaggaggcuuacaaccaacauaucaucucauauuacagcaaaaauaagaacaagcagaaacgccuccugaccgaagagauucccgaacaguucauaucucggcaacuuaaugacacaaaguauaucuccaaaauugugaagaaccuguugaguaaaaucguaagagaggaggaugaacaggaggucacuagcaagcacgugguuucucucaauggauccauuaccucaaggaugaagcaggacuggggucugaacgauguguggaauacgaucgucaguccacgauucgaacgccuaaacacccugacaaauagcaacgacuuuggccaguucgagcucaaaaaggaugccuacgggaacgagggaaaacggguguuucaaacuaccguaccugacgcaauagccaagggcuucacuaaaaagagaaucgaucauaggcaccacgcucuggacgcgcuugugauugcauguguuaaucguacacauaucaacuauuugaauaaccugaaugccaaggauaccgacgacaaagcugucaagcacgaauuacgcaacaaacucugcuuuaagacgaaacccgauucgaaugguaacuacaagugggaguuccauaagccaugggaaaaauuuacaaaggaggcccaggacaaacugaauaccacuauuguguccuucaagcagaacacacgggugaucaauaaaaccgucaacaaguacguuucuuauaaagaugaaaaugggaaccuuaauguggacgcaaacggccugccccagaagaaggugauaacucaaaccaaaggagauaauugggccauuagaaagccucuacacgcugagacaguaagcggcaaagucuuucucaagaggaucaaacagucacacaucacgauugccaacgcaaucgaacagguggaacugauaguugacaaggaggugaagaaacaguugaaggcgaaaauuaagcuguacccaaacaauaucgcugggcucaaaaagcauuuaaaggccuucccggucaugauuaacgauaaagcaaucgacaagauacaaauuuaugaaacccuggaggccacugcuacacgaaaaauccuugauaucaccuuugacgaaaagaaaauucagaagaucacagauacuggaauacagaagauucuguugaaucaccucaaacaagagaaguaccagaacaccguggacgagaaugguaaaaagcuggcaccccaugaaaucgccuucagugagaacggccuagaagaucugaauaaaaacauuacguuccuuaaugacgggaagaaccaccagccuaucaaaaagguucggaucuuugaggaaggaaauaaguucccacucggcgagguggguaacaaaauuaauaaguuuguagagacagcuaaagggaccaaccuguucuuugccgucuaugaaaaugacgauaagaaacgcaacuacaagacuauacccuucaacgaggugaucgaaagacagaagcaaggcuugaaugcggcccuggagauugacgagaacggaaauagguuacucuuuacccuguccccuaacgaucuuguguauaucccacuggaagacgagauuggcuacuugaauggggucuacuucaaaaaccucaauaaggaacagacaguucggaucuauaaauuugugucuuguacuggaggcgagggucauuucguacccaacaauuacagcaaggaaauaaucuccaacgagaaugggucaaacaauaaaaacgagcgaaugcugaauuuuaacaacuucaauauuaucuuugauggaaaggaaaagccggugaugauuaaaagcaucugcuggaagcuagaggucgacagacugggcaaagugauaaagauuaucaaauga

SEQ ID NO: 3450 - RNA, 4617 nt, Artificial Sequence
  Cas9 variant
augaagcacauccugggccucgaccuugggaccaacagcauuggaugggcccuggugaaauccgagcaggauugcgacgaugucgaaagaauaaaugguaucgaggcugcaggcucuaggauuauccccauggacgccgcgguuuugggggauuucgcuaagggaaacacaaaaucacaaacugccgaccggacggcagcccgcggcauucgacguaugggugaaagacauaaguuaaggcgggagcgccugaauagagugcuagauguaaugggguuucucccugaacacuacagugcugcacugaccagguauggaaaauucaaggacggcgaggaguguaagaucgccuggcggaaagaugaaagcggccaguggacauuuguguucgaggacuccuuucgcgaaaugcuugcugauuucgucgcccaucagccagaguggcuggcagggggacgaaaggugccguacgacuggacuauauauuacuugaggaaaaaggcacucucuaaaccccugaccaagcaggagcuggccuggcucuuacugaacuuuaaucaaaagagagguuauuaccagcuucggggcgaagaugagcacacagacgacaaagggaaguugguugaauauuacgcucugaaaguggucggaguggaggauaccggcgacaagaaagguaaggauacuugguucaacaucaugcuagaaaaugggaugguauaccgucgcccugccgcagaggcuccagacuggauuggaaaaacaaaggaguuuaucguuaccacggaucucgaaaaggacggcacucccaaaaaggauaaagagggcaacauuaagagaucguucaggaugccuaaagaagacgauuggacccugaucaagaagaaaacagagaaugacauagaucggucagggaagacugugggagaauauauuuacgacgcccuucuggcggacccaacccagaaaauccgagguaaguugguccgcacaguggagagaaaauauuacaaggaggaacucaagaaaauuaucaacagccagaagagguuuauccccgagcugaaugauaacgaauuauauggccggugcauuagugagcuguaccaauccaaugacgccuaucgccagucuauaagcuccugugauuucaccuaccucuuuguggacaacaucauuuucuaccagagaccucuuaaaucaaagaaaagucugaucgauaauugcccauaugaggaacauagcuacacggacucuaagacuggggaggucaagacagcaccgguuaaauguguggcuaaguccaaccccuuguuccaggaauuuaggcuauggcaauucguacagaacauacguauuuuugagcggcagaaaaagaucggagauucagugaaaaccgacgucgaugugacuggcgaauuuaucaagagcgccgacgauguugugagucuguuugacuuccucaaugaucgaaaagacauuacacaaucuguccugcuugguaccuauuuuaagaucaagaaaccuaaggggaaagacuccgauuacccauauagauggaacuacguggaggacaagacguaucccugcaaugagaccagggcucugauuuugaaaggccucaaggaugccggaauagacgaaggcuuccuggauaaggacaaagaguacagcuuauggcacauccuguacucgguagaagauaagcaggagauuacaaaagcaauggaaaaguuugccgcuaaaaacucucuagggggaaaguucgcggagguuuucuccucacucccuccauucaauaagaacuaugguaguuacagcgagaaagcaaucaagaaacugcuugccuugaugcgcacuggcaaguauugguccgcugacgccaucgauaaacacacccuggaacggauugacaagauaaucaauggggaguacgaugaaucuauuagaacaagggugcgcgagaaggcaaucaaccucacugacgucagccauuuucgaggacugccccuuuggcuggccuguuauauuguguacgaucggcacucagaaaguaaagacauaaccugcuggaauuguccggcugacaucgaucaguauuuggaccauuucaagcagcacucccuccguaacccuaucgucgagcaagugguuacagagacccugagaacugugagggauauuuggcgccaguacggcaaaaucgacgaaauucacaucgagaugggucgggauaugaagaaucccgccgacguaagagcaaaaaugagcaagaggaugauagauaacgaaaaugcgaacuuacgaauuaaagcuaugcuggccgaguucgcagacccagauuuugggaucgccggcguccgcccuuacucucccucacagcaggaaaugcuacggauuuaugaggagggagcucucgaaaguguggacgagguuccagaugaaaucaaugagauaaucagcaaguucaaccaaacggacauuaagaaaagacccacacauggcgagaucauuaaguacaaacuguggcuugaacagaaguaucaguccccuuacaccgggaggacuaucucuuugucgcgucuguuuaccgacgauuaucagauagagcacgugauuccacaaagccgcuacuucgacgauuccaugucaaacaaagucaucugcgaagccgaggugaaucagcucaaggaccggaugcugggauaugaauuuaucaaggcacaucacggugagaaaguauuacugaguucuggcgagacagugaccauucuuacugcugaagaguacgaaagauugguucagcucaacuucaggaagaauccggucaaaaugaagaaacugcuaauggaugacauccccgauaaguuuauugagcgacagcugaacgacagccgguacauauccaagaaaaucaagucacuccugagcaauauggugcgcgaugaaggggagcaagaggacauuucuaaaaacgugaucgccuguaauggagcgauuacagauagacuuaagagggacuggggcgucaacgauguuuggaaucauaucauauugccucgguucgaacgacugaacgccgugacggguuccgacagauuuaccacuacaaguaccaaugggcacacaaucccagacaugcccuuaaaccuccagaaaggcuucaauaagaagcgcauugaucacaggcaucacgcuauggacgcaaucgugauugccugcacuacccguagccauguaaaccugcuuaauaacgaggcugccaugucuaaaaacaaugcaguccgguaucagcuguccagaaaguugaggcgcuacgaagauacgauggugacccgaaacggagagacaagaacuaucucaguugcgcgggaauuucucaaaccuuggccaaccuucaaugccgacguggagaaggcucugaggggcauagucgugaguuuuaaacaaaaccuacgcguuauuaauaagacagugaacaaguaucagaaauucguauacaaugaggaaaagcacaucaaagagaagaaagccguccgucaggaagagagaaacgggcggcaucugcucgcaaucaggaagcccaugcacaaagauacuguguauggagaggugaaucugcgccgaauuaaggaagucagccuuaaggacgcuguugccaacccgaaagcagugguagauaaggacuugaaaaagaaacugauggccaugauagaguuaggcuacgaucucaagcagaucaccaaguauuucgaagacaauaaagaugcuuggcaagacgugaaccugaagaaaauuaaggucuacuacuuuacgaaagauacaggugacagauauuucgcgacccgguuugggaaugaccuugugacucuguucucgaagaucacaaaggccgaugacgcgaaaaagcagauugagaggaucaccgauacuggaauacagaaaauccuaaagcgccaccucgaagcuaacggcggugacugccagaaagccuuuuccgccgauggcauugacgagaugaauagaaacaucacccaacugaacgggggaaggccucauaagccaguuuacaaggugcggauuuaugagaaagcugauaaguucgcaaucggcacaaaagggaauaaggccgcgaaauuugucgaagcugccaagggaacgaacuuguucuuugcaguguaccugaaagaguaugaagacucuaccacuggcgagacaauaaagaagcguguuuucgauaccauucccuuaaaaacagugaucgaccgccucaagaauggucagacuccugcccccgaagagaaagauggggcuaagcugcuuuuuguccugagcccaaacgacuugguauaccucccuaccgaggacgugguuaaaaauggaacgaucaaccgaccccuggauaagagaaggauuuauaagauggugucauguacaggcaccgaaugcuacuacaucccauucauagucgcaaguccgauuguggacaaaguagaguucuuuucccuaaauaagaucggucgggccauuacuggcgaaaugaucaaagagauauguauuccuaucaagguggaucgccuggggaacaucaccgaagucaauaacgagaaaauuuga

SEQ ID NO: 3451 - RNA, 4623 nt, Artificial Sequence
  Cas9 variant
augaacaagauccugggccucgaccuugggaccaauagcauuggaugggcccugguggguacagaugaggaaggcaaccccauaagaaucuacaaauccgggucuaggauuaucccuaugucacaggacgucuugggaaauuucgaucggggcaacaguauuagccaaacugcugagcgcacguccuaucgagguguucguagauuaagggaacggcaucugcuacgcagagagaggcuccaccgggugcugcaccuuaugggguuucugccaucucauuacgaagaggcaaucggaugggacaagggcgauaauaaaaccuucgccaaguuuuauucggacacagagccgaaauugcccuggcgcaagaacgcggaacgagagcacgaguuccucuuuaauacuccuuacaacgagaugcugguagauuucagaaagaaucagccacagcuguuuaaaauaaagaaaaacggccaggagucacucauccccuaugacuggaccauuuacuauuuaaggaagaaagcucugagcaagccuaucaguaagaaagaacuugccuggauuaucuugaauuucaaccaaaagcggggguacuaccagcugcguggagaggaagaggaagaaaauuccaacaaacuaauagaguaucaugcacucacaguggucaaggugauugccgaugaaccacagaaagguaagucugacaucugguacaaugcugagcuggaaaacggcuggguuuaucgcagaagcuccaaaacuccccuuuuugauugggagucaaaggugaaggaguucgucgugaccacagaccugaacgcagaugggaguuugaaaguagacaaggagggaggcguuaaaaggagcuuucgggugccuucugaggacgauuggaugcucgucaagaaaaagaccgaauccgacauugagaagucagauaaaacgguggguugcuacaucuaugacacuauccugcagaauccaagccaaaagauucgagggaaauuagugcgcaccauagaaagaaaguucuacaaaaaggagcugacagaaauccucaacaagcagaaagaguuucacagugagcuucagaauaaggaacuguaucaggaguguauuaaagaauuguacccgcacaacgaggcccauuacgauucucuacuggucaaggacuauacugaucucuucguuaaugacaucauauucuaccaaaggccccugaaauccaaaaagagccuuauuucgaacugcccuuaugaguaccggguguaucgcaaugauucuggaaucguagaaagagugccaaucaaguguauugcuaagucccacccccuguaccaggaguuuagguuguggcaguucauccauaaccuccguauuuaugaacggcaacgagaggucaauggcaaaccugaaaccgacguggauauaacagccgaguuuaucccaaccacggaggacagaguuaagcuguucgacugguuaaacaauaaaaaggaaauuaaacaggauacucugcuacagucauacuuuaagaucaagaaaaagaaaggcgacgauaaguuccccuacagguggaacuauguggaggacaaagaauacccgugcaaugagacacgcgcgcucauccugagucggcuuaccaaguugaaccugagcgaagauuuucucacuaaggagauggagcuggcacuuuggcacauucuguauuccgucgaagacaaagaggaaauaaagaaagccuucaagucuuuugcucagaaacacaauuuggaugacagcuucguggaucaauuuaucaaguucccucccuuuaagaaagacuacgggucauauagugccaaggcaauuaaaaagcuccugccauuaaugagaaucggaaaauacugggaugagaaggcuauuuccgguaacacaaggagccgcauccugucuauaaacgaacgacuagaggacaugcggucaaguggcaagaaaaucgaggauguaagcgacgacgauauuccuaagcagguucucaaauccuucgacaaggugaauggggucuauucuggacugaacaccuaccaggccuguuacgcgguguauggccgucauucggaagccagcgagaucacgaaauggaagacaccccaggauauugacgauuaccuuaaugaguucaaacaacacuccuugagaaacccaaucgucgaacaggugauaaccgaaacucugaggguugugcgcgacauuuggaagaaguauggugauuuuucagaaauccauauugagcucgggcgggaaaugaaaaaucccgcagacaagagagcuaaaaugaccacacagaucagugagaacgaaaauacuaaccugaggaugaagucuuuacuggccgagcuuaaaaaucacaacgauguagagaauguccgaccuuacagcccaucccagcaagaaauauugaagaucuaugaggaaggcgugcucaacucaguuagcgagauuccggaagagaucauuaagaucaccaaaucuucccagcccagucagacagagcuggugcgcuacaagcuauggcuggaacagaaauaucggagcccuuacaccggagagauaauuccacucggcaagcuguucacuucugcuuacgaaaucgagcaugucaucccccaauccagauauuuugacgauucacuuaguaauaaagugauuugcgaaagcgagguaaacaaguugaaggggaaucuguuaggauacgaguucgugaaaaaccaccacgguguuaaggucgaacucaacuuuaauaaaacgguggagaucuucucgauuaacgaauaugaggaguuugugaagggcaauuacgggaaaaacaggggaaagaugaagaaacugcuucuggaagacauaccuaaguccuucaucgagcgucaguugaaugauacacgcuauauuucuaaagucguuaagggccuccugagcaacaucgugcgggaagacggugagcaggaagccaccucaaaacaugugauuccauguacugggggcguaaccacaauccuaaagcaagacuggggacugaaugaugucuggaacaagauagugacccccagauuugagaggaugaaugagcucacuaacacaagucuguucggccagugggaaaauaaagaggggaagcgaaucuuucggacggaaguuccgcuugaguugcagaaaggauucaacaagaaacgcauugaccacagacaucacgcaauggaugccaucgugauugcuugcgcgaccaggucccacgucacuuaccugaauaacgaaucuagcaaggcaaaugccaaagagauccgggacgguuuaaagcauaagcucuguuuuaaauccaagacagaugagaccggcaacuauaaauggcaguuccacaagccuugggacacauucacucaagaugugcaggacacccuggaaaacauaguuauuucauuuaaacagaaucuucgagugaucaacaagacgaccaauagauaccagaaguacgaggaagagaaaaagauccugaaaagccaagaaaagggggauaguugggcuauucgcaaaccacuacauaaggacacaguauucgccaaggucucucuccagaaaauaaagugcgugaaacuggcaauggccuugaaggauuggaaaaacaucguggacaagcagcugaagaaagagauuaggcguuuaauccucuccuauggaaaguuugacgcugagauucugaauaaauacuucaaggaucggaaauauaucuuuaaggacgucgauauaagcaaaguugacguguacuauuucgaaacugaguacguagccaccagaaagaaccuugauacaucguuugacaggaagucaaucgaaucuauuacugauaccggcauccagaaaauucuguugaaucaccucggugugaagaacaauaaccccgagcuggcauucagugcggaggggaucgacgaaaugaaucaacgcauagucgagcuaaacggcggaaaacagcaucagccuauuuauaaggugcgaauguacgaaccccugggcaauaaauuucaaguugggagaaucggaaacaagaaggauaaauacguggaggcugccccaggcacgaaucuuuucuaugcaaucuaccaguccgaagacaagaaacggauuuaugauacaaucccucucaacauaauuaucgagaggcagaagaaagagcuguuucccgucccagaaaauaaggaggacaaggauaacuuguacaaacuguuauucuggcucagcccgaacgacaugguguaucugccuaccgaaaaggagugggccaaucccgaccuuuucaacuuuaauaacaugacuaaaaaucagcgcaagaaacuguacaaguucauugaugguucugggacaaccgcuaacuuuaucccaaauacuguugccaacauaauuuucagcauccccaagaaagacuccggaaaguauucaaugggcaaucguaucgugcaaaacgaauuugguauuggcaguccucagagcaaaaaucagaaggcauucaccggggagaugaucaaagagagauguuggaaguugaaaauuaaccggcucggagauauaaucgaaugcauuaaguga

SEQ ID NO: 3452 - RNA, 4629 nt, Artificial Sequence
  Cas9 variant
auggagaagagaauccugggccucgaccuugggaccaacagcauuggaugggcccuggugaaaggugaaaggcacgagaaugauaacgaaacaauauuguccuacaucgaggcugcaggcucucggauuuuaccccuggacgccgcggcucagggggauuucgaaaagggaaauccugccaaaacucaaacgucagagcgcacccgaaugcguggcaugagacaucuacucgagaggagucugcuucggcgcgaaagacugcacagggucuuggacaucauggauuuucucccaccgcauuauagccagucccugacacgguacgguaaguucaaagcagacacugagugcaagcuggccuggcgcaagaccgaaacagggcacuaugaguuucucuuccaggauucuuuucaggagauguuacaagacuuccagaaccauggaaaacuggaagagaauaagaaaauucccuacgauuggaccaucuauuaccuucgaaagaaagcucuuacucagccuguuucgaagcaggaacuggcauggauacuacucaacuuuaaucaaaagagaggcuauuaccagagggaggaccaggccguggaugacaaccagaaaaagcggguagaauaccaagcucugaaagugaucucagucgaggauacaggcgagaagaaagggaagaauaccugguaugacgugcgucuugaaaacggacugguuuaccacuauagcgccccaauuaaacccgacuggaagggugagacgaaggaguucaucgugacuaccacaauugaucagaauggcaaaccugaauuggacaaggaugggaaaccaaaguacaguaugcgcgcgcccaaagaagacgauuauaagcuccugauggagaagacuaaaaaggacaucaccgauuccggaaaaucugucggcgaguacauauaugacgcauuacuggugaacccucagcaaaagauuagaggugggcucguaaggacaaucgaacgguacuuuuacaaaaaggagcuugaaaagauucuguugagccaggagcgauucaucccagaacuaaccgaucgcgagcuguauagaagguguguugaggaacucuacccguccaaugacgccuaucggcaccugaucgagucacgcgauaugagauaccuucugguggaagacauuuuguuuuaucagaggccccucaaaaguaagaaaagccugauagacgauugcccuuacgagucucguuccuaugucgaccgggagacgggagaaaucaagucaagcccagugaaauguauugcucagagucaucccuuauuccaagaguuucgacuguggcaguucauccacaaccuaagaauauaccagaaugaaaggucuguggagggcaagcuccagcuggaugucgacguuacugaagaggugcuuccuacaccagaguccaaggccgcauuguuccgcuuucugaacgaucgggaaaacguaacccaagagauucuccugaaagaaguguucaagggcagaaaacuuagcgucaaggacugccccuacagguggaauuaugcuggggaggguaaaaaguacccguguaacgaaacucgccaucugauguugaaacuccugaagaaggccggaaucgauacagcguuuuuaaccccugagaaagagcaggcccuguggcacaucauguauucgguggaagacaaggaucaguacgagaaagcacuaucuacguucgcucgaaagaaugaccuccccgauggcuuuaaagaacaguucaagaaggccccaaccuuuaaaaaggacuauggggcuuacucccugcgggccauuaaaaaguuguugccucugaugcguguuggagaguauuggucagcagauugcaucgacagugaaacaaaagagagaauuagccaaauaaucaggggcgagauggacgaaaaggugucccagcgcaugacuaagucucgggauagcuucaccgacauuucacaguuucagggucuccccgucuggcaagccuguuacgugguauacgggagacacagugaggcuacagaaauccagaggugggagaaaccagaggauaucgacguuuaucugaaggcguucaaacagcauuccuuacgaaaccccauuguggaacaagucgugcuggagacucuucgcgucgugcgggauauauggaagaccuacggcaaaguugacgaaauccacauugagaugggaagagauaugaagaauacagcagaagagaggaagcguaucuuuaaccgcaaucagcagaacgagaaugacaacuugcggauuaaagcccuccugaccgaguucaugaauccugauuuugaaaucgaaggcgugagaccauauagcccgucucagcaagaggcucuaaggauauacgaagacggggccuggucaggacuggaugaggagaaggaagacaaaaaggagcucgaagcaauccgagagauucuggguaaauucagucagagcgauaaggccaaacggcccacucauuccgaaguacuucgcuauaaggcuugguuggagcagagauacucuucgccuuauacgggcgaggccaucccacuggcaaaguuauucacacccgcguacgaaauugagcacgucaucccucagagcagguuuuucgacgacuccuuuucaaacaaagugguuugcgaagcugaggugaauaagcucaaagaucggaugcugggguacgaguucauaaaggcccaucaaggagaagucgugagucuuucuggcaccggucgaugugcacgcauucugagcccagaggaauaugagcagagaguaacugacugcuacaaacacaacaccgccaagaugaagaaauugcucauggaagagauccccgaugacuuuauucagaggcagaugaaugauucccguuauaucucaaagcuggugaaaagccuacugucuaacaugguucgggaggaaggggagagagaagcuauauccaagcacgucaucacauguaacggcaccauuacugacaggcucaaaaaggauuggggagugaaugacguguggaaccauaucauucugccgcgcuuccaacgaaugaaggaucuuacaggcagaaaugacuuugucgccguuaacagucaggggcacgagaucccuagcgugccacccgaauugcagaaaggauucaagaaaaagcggauagaucauaggcaccacgcaauggacgcuauugugaucgccugcacgacccgcaaucauguaaaccuguuaaauaacgaggcggccaugucugagaauaaagcuaaccguaucgcacucuccagaaagcugcggagguacgaaaauugcgccauuuauaaggguggcgagacuaaaaacaucucagucgcuaaggaauuucuuaaaccuugggccacauuccccgcagacguggagcgcgcgcugggggauauuguugugaguuuuaagcaaaaucuacgagucauaaacaaagccaccaaucacuacgaacauuauaaggacggaaagaaagugaagguuccacagaaaaagggcgauaugugggugguaagaaaaccucuccacaaggacacagucuacgcucuggugaacuugcggaacgugaaaacugucggucugaaggaugccaucuuaaugcccgacaggauugcaaauaaggaucucaaaaagaaaguuaaggagcugcuugcucagggggacgaucugaaaaagaucaagaaauacuucgagaccgaaaaggacacguggcaggauguggacgugaaaaagauugagguauauuacuuuagcgaagagaccgccaaccauuauuacgcaacacgcaaaccauucgaugccaaugucaagaucgacucggugacugacaccggcauacaaaagaucuugagaaggcaccucgaggaaaacggaaauaaagcugauguugcguucuccccggagggcauugcccggaugaacgaaaauaucuuucgucugaacgggaauaagcaccaucagccuauuuauaaagugcgcgucuacgagaaggcaaacaaauaucccgugggacagacaggcaauaaggcuucuaaguucguugaagccgccaaagguacuaaccuauaccuggcuguguacgagagcgaggucguagacaagaaaaccgcagaaaucucaaagaaacgaaguuaugugauaguuccacuuagagaugccguggcgaggcagaagcaagggguccccguggcuccugagcggaaugaagagggaggcaaacuccuguuuguauuguccccaaaggacuucguguacguccccacggaagaggagcgcucuaagggugaaguucuguuaccucucgauaaaaacagaauuuauaucaugauggacgccagcgauggcaucgugaauuuucugccguacuccguggcaaaccuuauuuaugcccugccaaaggaccaggcuucaggguucuguacagauggaaggaugauacagaacgaguuuggcuuggggagccccaaaaguaagaaugaacgggcacucaccggagagaugaucaaagaaauuugccugccugucaagguggaccgacuaggcagaaucacugagauuaacgguaauaagguuuga

SEQ ID NO: 3453 - RNA, 4644 nt, Artificial Sequence
  Cas9 variant
augaagaaaauccugggccucgaccuugggaccaacagcauuggaugggcccugacaaauaacgauuucgacaauaaguuggguuccauagagggcuuagggucuagaaucauucccaugucacaggaugugcugggaaaauuugacaguggcgucagcaucucccaaacugcugaaaggacgaaguaccgggguacccgccgacugguucagcguuuccuccugagaagggagcggcuucaccgcauucugaacaucuuggauuuucucccuagacauuauucugaagcaauagacuucgauaaaaaguuugggcaguucaagccagagagggaagagaaacugucguuuuacaagaaugagucagggaaaaaccaguuccuguuucucgaaagccaccaagagauguucagugaauuuaaguuaacacauccggaccugaaacaggugcccuaugauuggacuaucuacuaucuucggaagaaggccuugacccagaaaauuuccaaggaggagcuggcguggaucauucuaaauuucaaccagaaacgcggcuacuaucaacuccgaggcgaagaggaagagguaaauaagaacaaacuggaagaguuucacacacuugugaucgucgacgugauagagagagaaaaggggaaaucuggaguuugguacaaugugauucuggagaacgguuggaucuacaagagggaaagcaagauugcuuuguucgauuggaucggcaaacagaagaauuucaucgucaccacugagcucaacgacgaugggacaauuaaacugaauaaggacaacgaagagaaacgguccuuucguucaccuaaggaggacgauuggggauuacgcaagauaagaaccgaacagacgaucaaccagagugagaaaagcgugggcucuuucauuuaugacgaacugcucaagaaaccaaaucaaaagaucaaaggugagcuuguaaggacuauagaacggaaguuuuacaaggaugagcuguccaaaauuuugaaggcccagaucaccuuccauuaugagauccuaggggaccgaaacauuuacaaaaagugcaucgaugaacuguaucgccacaaugacucacacaaaaacaauauuaaggauaagggauuugacuaccucuuccuggaugacauaaucuuuuaucagagaccccuuaaaagcaagacaagucugauuucugauuguuccuuggaguucguuccuaucaaagacaagaaaggcauccucgugaaggacagcaacggcaaacaagucgugaagccacugaagugcauugcaaaaucgaaucccauauuucaggaguucagguuacugcaguuugugaagaaccuaaaaaucuacaagaaagaaauuaucaaugagauugaugucacuaacgacuaccucaagaccgaagaggaucugguugaacuuuucgacugguugaaugauaaggccgagaucucucagaaacaauuucuggcuuauccuaaguucaaacucaaggaagacaaauaccgguggaacuucguggaggauaagauauauccauguaaugagacacgcaaccaguuucugaaugcaaucgccaagauugacguaaacaaauccuucuuugaugcuaagaacacccaggaccuuuggcauauccuguacucagugacggauaaaacugaauuguucaguauuaauacagagaccgggauccagagcggagcccucuccacuuuugcgaagagacacaaccugucuaaugaguucgucagcaacuuuucaaaaauaaagccguauaauaaggacuacgguaguuauuccgaaaaagcaauuaagaaauuacugccccuaaugagguucggcagcaacuggaauaagaacaauaucgaugccaaaacacucgcucguauugacaagcugcaaaccggggaauuugacgagacgaugcggacccgagugagagagaaagccauccaucuuucuaagauaacagauuuccagggauugccucuguggcucgcaucauacaucauuuacgacaggcacagugaagcuagcaacaucuccaaguggaaaacuccagaggauauugccugguuucugaaucccaagaacaaaucuggcuucaagcagcacucguuacgcaauccuaucguugaacaggugauaaccgagacacugcgggucgugaaagacauuuggcaacauuauggugaagggaaggagaacuuuuucaaugagauccacaucgaacuuggcagagagaugaagaacaacgcgaaugauaggaaacgcauuacugaaaccaucaaccagaaugagaacacaaauuugcgaauuaaggccauacucaccgagcugaaaaacgacggaaucaaugauguacggccauacagccccucccagcaggaaauucuaaagaucuaugaggaaggcguuuacaacucagagauucguaaagaaaagcuggaggacaucgauaagauaaggaaaaaugcaaagccgacuccuagugagaucauuaaauauaagcucuggcuggaacaaggguacaucucucccuauacgggaaaacuuauuccauugagcgaccuguucacaaccaaguaccagaucgagcauauaauuccucaguccagauuauuugaugacucacucagcaacaaggugaucugcgaaucugaggucaaugaucugaaagguaacaauacugcucuugaguucauccugaagaacgaaggccgcauuguguugcucaccgggggaaaaacagucaagauauuuaccaaagaggccuacaaucaacacaucacuuccuauuacauuaagaacaagaguaaacagaagcggcugcuaacagaagagauccccgaaaaauucauugacagacagcugaacgacacgaaguauaucagcaaaauagugaagaaucuccugucuaaaaucguuagggaggaagaugagcaggaggugaccuccaagcauauuguaucacuuaacggcaguaucacuagccgaaugaagcaagacugggguuugaaugaugucuggaacaaaauugugucgccacgcuuugaacggcugaaugcuaucacaaacuccaaugacuucgggaaguuagagcucaaaaaggaugaauuuggcaacgccggaaaacagguuuuccagaccacagugcccgacgauauagcaaagggcuuuucuaagaaaagaauugaccacaggcaccaugcccuggaugcucuugucaucgcguguaucaaucguacucacauuaacuaccugaauaaccuaaaugcaaaggacgagaacgauaaaaccaucaagcaugagcuccgcaauaaacugugcuucaagacgaagccugacagcaacggaaauucaaaaugggaauuucacaagccaugggagaacuucaccaaaaagguggaagacgaguugaaccagacaauaauuaguuucaaacaaaauacucggguaaucaacaagaccgugaauaaguaucagguuuggaaagaagaggauggagccaugaagaaagucacagugaagcagacuaaaggugacaacugggcuauuagaaagccgauccacgccgagaccguguccggcaaagucuuucugaagaggauaaagcagucucauauuacgaucgcaaaugccaucgaacaaauugaguuaaucguugauaaagaagugcgaaagcagcucaaagcuaagauuaaacaguaccccaacaauaaggagggguucaagaaacaccugaaggccuuuccuauaaugaucaacggaaaagcaauugacaaggugcaaaucuaugaaacaaucgaggcgaccgcuacucgggagcgcaauaaccuugauauuacauucgacgagaaaaagauagaaaagaucaccgauacuggcauucagaaaauccuguugaaucaucucaagcaggaaauuuaccagaacgccaucgacgagagcgguaaaaagauagcaccacacgaaguagccuuuuccgagaucgggauugaugagcugaauaaaaacaucaagguccuaaauaacggcaagaaccaucaacccauuaaaaaggugagaaucuucgaagagucaaaaagguuuagccugggacagaguggcucuaagaccgacaaauacguugaaacagcuaaggggacgaaucuuuucuaugccauauacgagggcaaaaagggaaaccggaauuauaagaccauuccucucaacgaggugaucgaacgacagaaacagggucuaaauuccgcauuggucacugaugagaacgaaaauagacuguuauuuacacucagcccaaacgaccugguguacauucccaccaaugaggaaaagaaaaaccuuacaacuaucaauuucgauaagcugucgcgcgagcaaaccgagaggauauauaaauuuguuucauguacgucuggggaaggacacuucgugaguaacaauuacuccaaggagaucauuagcaacgaaaauggcucuaacaacaagaaugagcguauguuggaauuuaacaauagcaacacaaucuaugacgagaaagagaagccgguaaugauuaaauccgucugcuggaagcucgaaguggaccggcuggguaaaaucaagagaauaauuagguga

SEQ ID NO: 3454 - RNA, 4677 nt, Artificial Sequence
  Cas9 variant
augaagaaaauccugggccucgaccuugggaccaacagcauuggaugggcccuggugaaugucgauaagaacgguaaucccuucggcauagagggguugggauccagaaucauuccuauggaccaggcuacauuaucugauuuugaaaaaggcaacucaaagagucaaacugcagagaggacgauguuccggggugcccgccgacugcgugaaagaaaacaccuaaggcgggagcgccuccauagaauccugaaugaacuuaacuuucugccaauucacuacaggagcugcaucgacuucguucaucgguuggggaaguuuaaggcgaaucacgagccgaaaauagcuuggcgcuccaacgaucaggacaagauggaguucaucuuucaaaauucuuuccucgaaaugaugucggauuuuaccaaacgacagcccgagcuggugaaggaaggcaaaaagauuccuuaugacuggacaaucuacuuccugagaaagaaagcccucggacaaaggauugagaaggaggaauuagcauggcugcuuuugcauuuuaaccagaaacggggcuauuaccagcugcguggggaggaugaaaucgacgccacucgcucagcuaagaccagaaaauauuucgauaggaagauaauuaaaagcaucauugacacaggagaggaauacaagggucuaaagguacucaucguggagcuggauaauggcaaccaggggaaaaucuuuaagcaagaggucccagacugggugggacaggagaaaaauauuauagcaaccguugaccuugauaaggacggcaaagaucgguucgacaagggugugcugagucagcgauucuccauccccucugauagcgaaugggaaacugaguggaaguugauuaaacucaagacagaagaggaccuggaggccucccagaaaaccgucgggacguauaucuacgauucauuacugaagaacccuaaucagaaaauaaagggaaagcucgugcgcacuauugaaagaaaauacuauagggacgagcuucgggcuauccugaacaagcagcgcgaauuucacccagaguugaacgauaaaaagcuauaccagcacuguaucuucagucuguauccccaaaaugaagccuuuagaaacagcauugcgaauaaagacuucaccuaccucuuucuggaggauaucauuuucuaucagaggccucuuaagucuaagaaauccacaauaaacaauugcgcauacgagguacgucgguauauggacaaggaaacuaaagagcugaaggaaguuccauugaaauguaucgccaagucacauccgauuuuucaggaguuccgacucuggcaguuuaucagcaaccugagaaucuacaaaaaggacauuaccgauauagacgugacaaaugauuucuuacacagucaagacgauuacgcuaaccuguuugaguggcuaaauaacaagaaugaaaucgaccagaaagccuuccucaaguaucccgcauuuggcuucaaaaaggaugcugucaacuacagguggaauuauguggaggacaaaucuuacccuugcaacaagacccgcuccgccauucugagcaaacuugauaaacaugaacaggaguucuugacgaaggaacuggagcucaaaaucuggcagcugcuuuauucgguuaauucuaaggaggaaauugacaaagcgcugaacgucaacuccccaaagaucaauaacaagauaucaaucgaucacacuggcauuuugcacgagcucaaaaguagcucccugucugacaucagcauucaacgguuaaaggccaucaauuuugaagagaaagauuacgggucauauaguuacaaggcaauuaaaaagcugcuagcucucaugagacagggaaaguacuucgacaacacagccauaaccgacgcuacuaaagccaggaucaauuccauuuuugaucgccuggaaagcaucucuuucgaccccgagcgaauaaacucaaucagugaugacgauauuccuaagcagauccuuaagagcuuuauuaaguugaaucggacauaugguggcuucaacaccuaccaggcauguuaugccguuuacgggcgucauuccgaggcuaaagaaaucgcgaagugggagaaaccagaagacauagaucaauaucuggcaaaguuuaagcagcacucucucagaaaucccauuguggagcagaucaucacggaaacccugaggguagugcgcgacauuuggaaaaagcaugccuacaaaacaaucaacaaggauaaucagggaaacaauugcgagucggagagcgaauuaacugagauucacauagaacugggccgggacaugaaaaacaauaaguccgagagacuuaggaucucacgaauuaacagugagaacgaaaauaccaacuugcgcauccggaagcuccugauugaguucaaugauccggaauuuggugucgagaacgugagaccucauucucccagccaacaggaaauccuaaggauauaugaggacgggguucugaaauccggcguggagaucccagaauacgucgauaauauuaucaagaaauucaaggagacagacgugaaaaagcagccuucaaagagcgaaguacuccguuacaaacuguggcuugagcaaaaguaucgcucucccuacacuaacgaaguuauuccauugggaaaacuguuuaccaaugacuaucagaucgagcacauaauuccccagucccgguacuucgaugacaguuuuagcaacaaggugaucugugaggcugaagucaaucaguuaaaagagaacgaacucggcugcgaguucaucaugaauaacgggggaagaauuguggaacugucuuucgguaagacagucaggauacuugauuuugaggccuaugagcaauucgugcagcagaauuacgcaggcaaccgaccuaagcugcggaauuugcucaugaccgaaaucccaaacgacuuuauugaucgccagcugaacgacuccagauauaucucaaaaguugugaaggggcuacugaguaauauuguaagggaggauggagaagccgagagcacuucgaaaaaccucaucuccuguacgggcggugucacagcucggcugaagauggacugggggcuuaaugauguguggaacaauuugauauacccgcgauucgagagacugaacgaauuaaccaauucuaaccaauuuggcuacugggacaaaaaggauggaaagaauguuuuccagacucaggugcccauggacauccagaaaggcuuuaacaagaaacgcauugaccacaggcaucacgcccucgaugcacuggucaucgcgugcgcuacccguagccauauuaauuaucuuaacaaugagucagccaagaguaacuccaaagaaucucgguacgaccugagaaggaagcuacgccgacucgaggugauccaaaaagaauauacaauaaaugggagaaaggagauucggaacaucgagguagcaaaggaguucuacaaaccuuggaauagcuuuacccaggaugcccaguccgcucuggaaaacaucgugguuucauucaagcaaaacuugagggucauuaauaaaacuacaaacuauuuucugcgcuucaauaaggaagguaaaaagaucuucgagacgcagaccagcggaaguaacugggccauacguaagccauuacacaaagacacugcauuuggccucgugaaucugaagagaacaaaaaccgugucucuugcuaacgccauucuggauuacgaccagaucgucaaucggaaguuguggacaaaaauuaaggaacucaucuccauaggguaugauaacaagaggauucugaaauacuucacugacgauaaggagaauuggaacgagaucaucagcucgggaauugaaguguuuuacuauaccgacaauuucgagaaacagguggcgacgcgcaagccccuagauaccucauuuacagaaucuaaaaucauuaacaguauaacugaccugggcauccacaagauucuucucgcccaucugcgagcuaaugaggguaacccuaauaucgcauucuccccagaagggaucgagaccaugaacagacacauuugugaguugaacggcggaaaguuucaucaccccauauacaaagugcggguacaugaaccgcugggcuauaaguucaaagucggggauaagggaaauaggagcacaaaauacguggaggccgcuaagggcacuaacuuauuuuucgguaucuauauuaauucucaagggauccgcagcuacgaaaccauuccucucaacguugccaucgagagacagaaacagggacuguccccagugcccgacaauaacgagcuuggcgaaaggcuguuguuuuggcucucaccuaaugaccuggucuaucuacccacgagugaugagguggaaagcgguauaugcugcaacaagcugggcaucgaccggauuuacaagaugguuucuuguacaggguacgugggagauuucaucccagcacacauugcgaauccuaucauacagacccuugagcucggcuccaacaauaaagcccaacgugcuuggacuggggaaaugauuaaggagaucugcauucccguaaaagucgaccgcaugggaaacaucguggagauauuuaaucgaaacaagaauuga

SEQ ID NO: 3455 - RNA, 4695 nt, Artificial Sequence
  Cas9 variant
auggccaagauccugggccucgaccuugggaccaacagcauuggaugggcuauaguggaugacaaaaauuccaagauccuggauacaggugucagaauuuuccccgagggcguuguggcaaaaacuaucgggucuggagacaaggaagagaguaaaaacgccaagaggcgggaaucacgccagacgcgacguggcuuuuacagaaagagguugcggaaaauuaaguuacugcgcacccuaaucaauuucaaaaugugcccucucgagcacuuugaacuggauguauggagcaagugggacaaaauaaagaagaaagaggguagaauggcgccagagcuuuuccugccggaaaacuccgcuuauaauuuguggcucaagcaaaaccccuacauccugagggauaaagcccugucuaaggaccucacauuaacugaguuugggcgggugcuguaucaucuuauucagcgccgaggauucuugucgaauagaaaaggcaaggaugacggcaaaaucuacgggggaaaggaagguauugucggcaucgauaagaccaacgagcagauuaaaaauucaacacuggggaaguuucuauucaaaauacucccuaaggagggagaaccauuuaaaaucauugaggacgaacugggcaacgagcuuagggugcggagccguuauacccugcgcgauauguacaucgcagaguucgaagccaucuggaauagacaggcuaagcacuugggucucgacaacauuuauuacaguaauguuaagaacgugcuguuaaaagggucccugaagaauaaaaagaacgagaggaaaauaaaccaucucaagaagaucaaaggaaauggcaacauugaaaucauaacucuuaauaacaaucugucuaagaacgagaaacccaaguacuugcuaaaaauugcaacaaagcugccucucaaggaauuucuggccggccggaucgagaaagacgaagaugggaagaucaaauucaagagcaaugaguccgucuuguuuuggcaacgaccacugcgcucacagaaaaaguugcucgcuaaauguagauucgagcccgaccugaaggaugacaacggaaaguucauucagaaagguaagaccccuugccacuuaagucauccacuguaugaagaguacagggccuaucaguacgugaauaacaucgaauauggcaaaaagcaacggcuagaggaaagccagcgcaaacagguaauugaucucauaaauucuaaggacgggaacuuuaaguucuccgagaucaaaaagaaacugaaacuuucauacgagacguuuaauuauagcgaugacaguucuguuaacggaaauuacaugauuaaaaacuugaacuccaucuucccgaaggaaauccuggagaaggaauuuguggucaaugugaacaaagaggauauuauagaguacggcuaugaaagaaucuggcaccucuuccacuuuugugaggacaaugaugugcugauuaagaaacuucaggacaacuucgaccugagcgaaaaugauaucgagaagauuucgaaaaucaacuugaaggaagguuacucuaaugucucccucaaggcgaucaaaaacauacugcccuauuuaaaggaggggaaacugcuaucagacgcaguuauucucggcggagugaggaauguauuuggcaagaaauggcaugaguucaucgauuuucacgaaaagauugagaaagacauccuguacauaaaccaucaaaagaguaauaaggaaggggaggccauugagaaaaucaagaaauaucuuauugauuacaaguucggauuuacugaaaacgacaaucguuucaaaaaguuguaucaccacagccaggauguggucgaggugaagcugcagaaaaagaucgguccuguugaagaccuccggaacccaauagugcaacagggcgucaaugaggugcgaagacugguaaacgaauuacuggauguucaugggaaauucgaccaggugagggucgagcuuggacgcgauuugaagaacaauaaauccaagcgggaagagaucggcuacaagauuagagagaacaccgcuaaaaaugaaaaggccaaagagcuccugaucgaauacggucuaaggcagucucgcgacaacgugcaaaagguccugcucuuucaggagaugcuggaucgagggacaguggcaguuugccccuauacuaauaaaaccauuaacaucagcgacgugcuuggcaaugagaacaagaugcagauagaacacauuaucccuaagucaaucaguuuggacgauuccuucgcuaauaaaacacugugugacagcaaguuuaacggauuaaaaggcgagcggaccccauacgaguucuaucagauuaauaacgaugccaaucucuggggagggucuaagucaugggaagaaaucgagcguagaacguuuaggauucugcccuacaguaaagcgaagcgcuucacuagcaagacaaaauuugagaccaacgacuucauacaacggcagcuuaaugauacuagauauaucuccaagaaaacaaaggaaauucugucucagaucugcgaggacguaagggucaugccggguucguugaccgccgaacuccgaaaacuguggggccuaaacaacauucugcauccugcauuugugcucgaucugcccgcccuucacaucgacgcuaauaagcauauaccacacuacguuguguuggaugaggacaacgucccuauccugagccagcgcauuuauaaugauaaacccaucuuaaaggcuaaccaaacguccauuaccggguucguggacaaugaaaucuuuaagucaaaagagaaguacguaaaauucgaggugaaggccccaaaccucaguaauggagaauacugggcaaaacugcuucugucuaaccccaagagcauaguucgggucuuuaaggagaaaccuaaguccacagaaaaugagauuguggugagaggcaaaaucgaaaaggagaaauucaagcacgagggucuaucagggaucaacgccgaaggcaaggagaauggaacuuauugggcuaaacucagcauugucgauaagaaauucaagaaaccaaagaaggacgaccagccgaaaaagaacggcaaacagauacuguuguuuggggcgguuaaggaaggaguguucucuuccuacauguaugagugugaugcagaccuggaggauggcaaauacugguuaauccucgacauugauuuugaaaauguggaguucgaaaaggcccugaacgagaggcccgaaguacuugagaaucagauccugauucaagguaucaccaacgacgagaaugucuuugugagugauauggacugccagcaucaguucuugaugaacgaagggaaaggaaaguauuacguucucuuugauauaaucagcgaggugaacgaguucuauccuauuaagacaaaaucuccagaacuggaaaauggccaaucccuaacugaggguaccaucugggucgacaaguacacaggcgagauuaaauuugaucccaagaaaaaccgugaagaccaccgccaucacgcuaucgacgcccuggugauagcacuuaccaaggagacuuacuuccagcagcucucacggagaaaugccaguagcgaaaacaagaaaagggggaaugaguaugaaaaggagcagcuggauuuugcugagccuuggaaagaguuccacguugacgcccaaaagucgauuaacuccaucuugaucucucauaaacagaauaagaacauucugacgaagaucacaaagaagauaaccaaaaauggaaagacuuacaaaagcgaaggcaugucagugcgagggcaguuacacgauaagaccuauuacggacauaacaagaauuguaaagcagacgaauauguauaccgggucgauauuaacaaucucaguuucucccagcugacaaacaucauugaccuuaaucugaaggcggugaucguggagggcgucauuaaaaaguuugaggaaucugagaaacuucucuucaagaaaaugaacagcaagguucaaaaccuggauaaguccaaagugaagaaaauaaaggcuaaaguagacaagauccuaaaggaaaccucauuuuucaugccaaaugaggguaaacgcuauaucagacugaacauuaucgaacccgccaauuuugagaggaugccggugccuauuaagaaaguccggauacgaaaggugcuuagaaacgcagagaaacucaauaacgaaaucaagcaguucguugauccacagaauaaccaccaugugcugauuuacaaggacgagaaugggaacuugaaagaagaggucgugacuuuuuggacaguuguggaacgcaagaggacgggagagcccgucuacaaauuaccuagcgauggcaagaaaaucguaaccacucugcagaucaaugacauguuccuccugggucuuaacgaggaugaaauuaauugggagaaccccaauuauaaccaccugaaggaacacuuguaccgugugcaaaaguuuacaaguggcgacuucuauuuucggauagccaaaaccucuuccauccagaacggggaggaaaagcagcaaauuaauagcuucggacuaggcaaaaacggguggcugacacauaauccaaucaagguuaaaauuucggugucaggaaagauccucaaggucuga

SEQ ID NO: 3456 - RNA, 4713 nt, Artificial Sequence
  Cas9 variant
auggagaacagcaauaacuccucuaagaaauacuaucugggccucgacauggggaccgauucaugcggauggugugugacagacgauaaguacaauaucauuagaagucacaaaaagauauauggucccgacggcaaacuugucaagagggaagggugccaucuguggggaagccgguuguuccgcccugccaacacugcuaagucccgacguuuaaauagaacggcaaggcggcgccuggccagaaggcggcgccgaaucauucuacucagagagcuguuucagccagaaaucgauaaaguugacccgaacuucuuuaggcggcuugaucaaucuaaucuguggaacgaggacaaggauaaagaauugcagauggagcacaauuuccucuuuaacgacaaggaucugaccgacaaagaguacuauaaggauuuccccacaauuuaccaucugcguaaggcgauggugaauggccucacuaucaacgguuauuacuacgacccuaaaaagcaguuugacauacgcgaaguauauuuagugcuggcucacaugaucaaauacagagggaauuuccuuauggagggagaugucaaggacucggugguugauccaaccuauuugaaacaguguuuugacaacauugaugugauccugauuucacuaaauaacggcgaagacgaugagaacgaggacgauaagaucgaccccagcgaaugcuguuucaaugucgaugagaaaaaggccaggaagcucgcaaacaauuuucaagaaacaaacaaagugagugaccuggaggacgaugaacgggaccuuuucggcaaguuuaauuccaaagauauacgaaagaaaauucugaaguugaucaacgggggaucugguguaaagcucaaagacuuccugccuaaggagauuuuaguugcccaugauggcgacgaugaguacggggacaaaaagaucgaucugagcuccgaaacccucgaggacgauaucaauggauauucacuuccagaaaguuacguggagauuauacuggaagcuaaaaagaucuaugacuucaagacuuuggcauaccuacugcacggcaaaagccuccugugcgaugccauggucaacguguacgaggagcacaaggaacagcuugcugcccugaaacgcuuguauaagaaauacgcgacaaaggagcaguauuacuuuauguucagagacucuaggauucucgacggugaugacuccgaugacgaagaggauaaggaagagucaaauaaagaggaaagcaaggacaaaaagaaaaaggcaaguuaugugucuuacaucggguauaccaaaacgaacuccaaggccaaguacacuggagcucauauaaccagcgagaaaaauauuucggcccugaucaagcagaucaaagaugacuuaaaguuugaugaccugaaaucuaaggucgaugaccccucccaacagaacgaacuaucagaugaggacaagcucgacauucaguguaucgaggaagcaauugagaguaauacauuccugccucggcagaacagccgcaauaacggcgcuuuuccauaccaacuuaacuugaaugaaaugagaacuauaaucgagaaccaguccaaauauuacccguuccugaaggauaaagcccccucuuuuccugacggcaagaccgaagaguauaaaauuguuagccuccugaaguucaagaucccauacuauaucgggccccuuucacagccuaaugauuacgugagggacgauaaacgugacaaccacuggguacaauuucggggagagaauaaccaggguauuauaaauccauggaacuucagucagaucguggaucuggaaggcacagcggacaaguuuauuuccaauuugaccaacuauugcacguacaucuucggggagaauacucuccccaaagaaagccugauuuuucaggccuacaaggucuuaaacgaucugaauaaccuaaaagugaauggaucucucaucucaaaggaggacaaggauuauauaauccaaaacguuuaccugaaaaagaaaaagauuaaaggcaaggacaucgugaacgcacuuaaaaauaaguauaaguugagugacgaagauccgacagucaccacuaaagguagcgggaaguccauuggcgaggacgagguggaucugacaauguucaacucuucgcucagcuccuucaucgacaugucagauccuaaugcuuuuggacccgaguucuacaaagacaguaacaaguuugaacuggccgaaaaaguaauagaguuaauuaccaucguugaagauaaggaccugcuuaaggagcgauugaaaaagcucggccugucugauaaucaggugaacuaucuauucaaacagaaguacagcgggugggcuccacuguccagaaaacuccuggacggaauuacgaucgauugugucaaugagaacaccggugaagccuauccugugacaauaaucgacgucaugagggauacuccccuuaauuuuauggagauuuacgaaaccaaggagucacaguucagcggcuuuaaggagaaaguggcagaauugaacgacgagaagaaacugucucgcgacgauuuaaucgaagaguccuacgccaguccagcuaugaagcggagcguuagacaaacauucaaagugauugacgaacucaagaauacucugaacaucgaucauuuugacaggauauucguagaggcgacccgcgcacccggggaggccggaaagauggucaaaucucgaaagaaacagcuucaggaggcuuaugaugccgcaaaggaccugguggaucaggaaucccgggacgauuugcaaaaacuccgugacgaucuggaaaagcagacagacgaucagcuaagaaggaagaaaguuuaccuguauuuuaugcagcucggccgcucaguguacaguggugagaagauugaccugaaugaacuugacaaaaacuaugauaucgaccacaucauuccucaagccaaguugaaagaugacagcuucaauaacaugguccugguggagcgggaguuaaacaauaagaaacaggaugaauacccaaucccgucgaccauuauauccgagcacgggagaaacuggauccagaagcucgcuaagauucaagacaaaaauaagaggucuuauuuuaugcccaaagauaaggccaaccgacugcuucgcccugaaagcaaacagcugacuucagacgagcuaaauggcuucaucaaccggcagcucacgcugacaaaucagaguguaaaggcagugugcgauauuuugaagaugaccgaaaaaggauccgagaucguuuacucuaaggcgaacuucgucagcgacuuuagaaaacuguguggcgaguuaaggccauccuacgaugcuuucgugaaggugcgugacauaaaugacuuucaucacgccaacgaugcauaucucaauaucgucguugggaacguguacuaugaaaaauucaagaauuuuuacauuaacaaucgcaucgacuaugauaacaauggaaagaaagaccugucagugcuugccagcaagcuguucacuaaaacccaagcugaugacaagacagguaacauuuacugggaggcccgguuucauaacgaaaaagagaccgauaguaauggcaaggagagaacuaucaagguaagggacgaagggacagagucuacguucgauaaaauagaauauuacauggaguugaacgacccccucgucacccagaugcaguacacucuguccggaaagcagggcuuuuucaaaaagauuacacuaaaaaccaaggcaaaagauaaugaagacaacagcgauaagcuguuuccucuuaagcaauaucuccgaucggacucaaauaaagugauggacguuaacaaguacgguggguauucugauaugaucacaccauacuucaugcuggugcagagugagggcaaaaagggaaaacacaucuauuccuuggagagcauucccacuauauaccugaagucuuucaagaaaaaggaagaggacaucauuaauuauuuaagcugcaaaaacaagcucaaaaauccggucgugaucuccgauaagcugcuuaugcggaccauuguuaagaucccuuacuuuaaaaacgacucaaaucugaguuuggugaagcucggcacgagcgggcgcaccggaaacaauauaaucuacauuaaccugucugaacuaauccugccaauugaguggaaaaauuauuacagaaagaucuccaaccuucucggcacaaacguaucaaguacuaaacccaaggaucugagcaaguucaccgaacagaugaaaaaugacccuacauccacuuuggucgaugguucuaacaagguggagcaugacaaaaauaacagguuuuucucguauuuaauaaauaacgugauuaauaagcccaucuuugaggggcugccaaaaaccagcugcucauucaucaagcucgaauccaaauacgaugaguuuuguagucugaacacgcuugaacaggcuaagauuaucgccacaauaauuaagcuguugucuugcaaaagcguccaaggauguaagcuauccaaucugucaggccucccuucuagccugggugcgcuuaucaguaacaaagccuuaaccgagggcacuauuaucuccaaggaaagcucuugcgggcugaaagagaauauaauuuucguugugcccaacgacuga

SEQ ID NO: 3457 - RNA, 5067 nt, Artificial Sequence
  Cas9 variant
auggaguucaagaaagugcugggccucgacaucgggaccaacagcauuggaugcgcccuucuguccuugcccaagucuauacaggauuacgguaaaggcgggagauuagaauggcugacaucaagggucaucccucuagacgcugauuauaugaaggcauuuauugacggaaaaaauggccucccacaaguuaucacuccggccgguaagcggcgccagaagcgagggagucguagacugaaacacagguacaagcuucggcgcagcagacugauuaggguguucaaaacguugaacuggcuccccgaggauuuuccucuggacaauccaaagcggaucaaagaaaccauauccacagagggaaaguucucuuuucgcaucucggauuauguacccauuucagacgaaagcuaccgagaguucuauagagaguuuggcuacccugaaaacgagaucgaacaggugauugaggagaucaauuucaggcggaagacuaaaggcaagaacaaaaauccaaugauaaagcugcuccccgaagauugggucguguauuacuuacguaaaaaggcgcugauuaaaccuaccacaaaggaggaacuuauccgcauuaucuacuuguuuaaccagagaaggggguucaagaguucccggaaagaccugaccgagacugcuauccuagauuaugacgaauuugccaagcgacucgcagagaaagagaaguacucugccgaaaauuaugagacaaaauucguuagcauuaccaaggugaaggaagucguggagcugaaaacggauggacgcaaggguaaaaagagauuuaaaguaauacuugaagacuccaggaucgagccauacgagauugaacggaaggagaagccggacugggaaggcaaagaguauacuuuccugguuacccaaaaguuggaaaaagggaaguucaaacagaacaagcccgaucucccuaaggaggaggacugggcucuguguacaacugcauuagauaaucgcaugggaucaaaacauccaggcgaauuuuucuuugacgagcugcucaaggccuucaaagaaaagagagguuacaaaaucaggcaguaucccgugaaccguuggcgguacaagaaagagcuugaguuuauauggaccaagcagugccaacugaauccugaauugaacaaucuaaacauuaacaaggagauccugcgaaaacucgcuacaguccuguacccaagucagagcaaguucuuugggcccaaaaucaaggaauucgagaauucugaugugcuucacauuaucuccgaagacauuauauauuaccagagagaucugaaaucacagaagagcuugaucagugaguguagguaugagaagcgcaaaggaauugacggcgaaaucuacggccucaagugcaucccgaaaucuuccccucuguaucaagaguuucggauuuggcaggauauacauaacaucaaggugauuagaaaagaaagcgaggucaaugggaagaagaaaaucaacauugacgaaacccaguuauacaucaaugagaacauaaaggagaaacuguucgaacuauuuaauucgaaggauucucucuccgagaaagacauccuggaacuuauuucauugaacaucauuaauaguggaaucaagauaagcaagaaagaggaagagacgacucacaggauuaaccuguucgccaaucgcaaggagcucaaagguaacgaaacaaagucccgauaucggaaaguuuuuaagaaacugggcuucgacggggaguacauccuuaaucaucccucuaagcugaaccguuuguggcacagcgauuacucaaaugacuaugcggauaaggaaaaaaccgagaagaguauucucuccagccugggauggaaaaacagaaacggcaagugggagaaaucuaagaauuacgacguguucaacuuaccacuggaaguagcaaaggccaucgcuaaucuaccuccccucaaaaaggaguaugguucauacagugcccuggcaauaaggaaaaugcuuguggucaugcgcgaugggaaguauuggcaacacccagaccagaucgcuaaagaucaggaaaacacuagcuugaugcuguuugacaagaaucucauucagcugacaaacaaucaacggaagguguuaaacaaauaccugcuuaccuuggccgagguucagaagagauccacgcucaucaaacagaagcugaaugaaauugagcauaaccccuauaaacuagagcuggugucugaucaggaccucgaaaagcaaguccugaagucguuccuugagaaaaagaaugaaagcgauuacuugaaaggccugaagaccuaccaggcgggauauuuaaucuacggcaaacacuccgagaaggacgugccuauaguaaacucaccagaugaacucggggaguauauuaggaagaaacugccgaauaacagucuucgaaaucccaucguugagcaggugauccgcgaaacaauuuuuaucguccgggacguguggaagucuuucggaauuauagacgagauccauauugaacuggguagagaguugaaaaacaacagcgaagagaggaagaaaacuuccgagucacaggaaaagaauuuucaagagaaagaacgugcccgcaagcuccugaaggagcuacugaacagcucuaauuucgagcacuacgaugaaaacggcaauaaaaucuuuuccaguuucaccgucaacccuaauccagacagcccccucgauauugagaaguuucggaucuggaaaaaccagucugggcugacagacgaagagcuuaauaagaaauugaaggaugaaaagauaccuacugagaucgaggugaaaaaguauauucugugguuaacccagaaauguagauccccauacacaggaaagaucauuccccucucaaaacuguucgacaguaacguuuaugaaaucgagcacauaauuccgaggagcaagaugaagaaugauucgaccaacaaucuugugaucugcgaacugggcguaaacaaagcaaagggugaccgacuagcugccaauuuuaucuccgagucuaacgggaaauguaaguucggcgaagucgaguacacucuccugaaauacggagauuauuugcaguacugcaaggacacguuuaaguaucaaaaagcuaaguacaaaaaccuguuagccacagagccuccagaagauuucauugagcggcagauaaaugacacccgcuauaucggcagaaagcucgcagaacugcuuacucccgugguuaaagauagcaagaacauuaucuucaccauugggucaaucacaagugagcugaaaauaaccuggggauugaaugguguguggaaggacauccucaggccucgguuuaagcgacuggaauccauuaucaacaaaaagcuaauuuuccaggacgaggaugaccccaauaaauaccauuuugaucugucuaucaacccacaacuugacaaggagggccucaaaagacuggaucaccgccaucacgccuuggacgcuacuauaauugcggcaacaacgagggaacauguccguuaucugaauagcuuaaacgccgcugauaaugacgaggaaaagcgggaguacuuccucucccuguguaaccacaagaucagagauuuuaaacuuccuugggagaauuucaccucagaagugaagagcaaacuguugaguugcguagugucuuacaaggaguccaaacccauccucagcgacccauuuaacaaguaucugaagugggaauacaaaaaugggaaguggcagaaaguuuucgccauucagaucaagaacgauagguggaaagcaguccgccgaucgauguuuaaggagccgauaggaacuguguggauuaagaaaaucaaggaagugucacuaaaagaggccauuaagauccaggcuauaugggaggaagucaaaaaugacccuguuagaaagaaaaaggagaaguauauuuacgacgauuaugcccaaaaagugaucgcaaagaucgugcaggaacugggccuuucuaguuccaugcggaaacaggacgaugagaagcucaacaaauucauuaaugaagcgaagguaagcgcuggugucaacaagaaccugaauacaaccaacaaaacaaucuacaauuuggaggggagguuuuaugagaagauuaaaguggccgaauacguuuuauacaaggcaaaacgcaugccccugaacaagaaggaguauauagaaaaacucucucugcagaagauguucaaugaccuuccaaacuucauccuggagaaaagcauuuuggauaauuaccccgaaauccuaaaggagcuggaguccgacaacaaauauaucauugaaccucacaagaagaauaacccagugaaucgucuccugcuugagcauauauuagaauaccacaacaaucccaaagaggccuuuucaacugagggccuggaaaagcucaacaaaaaggcuaucaauaaaauuggaaagccuaucaaguauauuaccagauuggauggcgacaucaacgaggaagagauauuccggggggccgucuuugaaacggauaaaggaaguaacguguacuucguuauguaugagaauaaccaaaccaaggacagggaguuucugaaaccgaauccaagcaucucugugcucaaggcaauugaacauaaaaacaagaucgauuucuuugcucccaaucgccugggcuucucccgaauuauccuuucaccuggugaccugguauacgucccaacaaacgaucaguacguguugauaaaagacaauaguagcaacgagacuauuaucaauugggacgauaacgaauuuauuuccaauagaaucuaucaggugaagaaguucaccgggaacucuuguuacuuucuaaaaaaugacauagccucgcugauccucagcuauucagcguccaacggagucggcgaguucgguagucagaauauuucugaauacagcguugaugaccccccuauccggauuaaggaugugugcaucaaaauaaggguagaccgcuuaggcaacgugagaccgcuguga

SEQ ID NO: 3458 - RNA, 3924 nt, Artificial Sequence
  Cpf1 variant
augacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacuga

SEQ ID NO: 3459 - RNA, 3903 nt, Artificial Sequence
  Cpf1 variant
augagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaaaaguuuuaagggcuggaccacauauuucaaaggguuucaugaaaaucgcaagaacguguacuccucaaaugauaucccuacuagcauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaagcuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacuga

SEQ ID NO: 3460 - RNA, 1341 nt, Artificial Sequence
  Cpf1 variant
augaagcccgacaucaaagauagagaguacauguauaggcugauuauaggccaacucuucuacgacgggcaccagcagaucgccgugaaccuugcuaauacccugggaugcagcgcaccuccaccgcccccuuccgauaaguuguuucgguuagucacaauugccaaacaguucguugaagacccagauuauaaggcggaggaaaacacuaugcccaugcaguuugagacgucuucagcuggucuggaccuacaauacgaugccgacguggcagccaccaguccugaaccaagccaguaugagacaaucuaccucacuguacauaaagcucccugucgcgcagccgcuuucaauuccgauggcucucugauugccaccgggucggcggacugcucaaucaagauaauggauguggagcgaauccuugcacgugaaaaggagcacagagaaaugaacgagaauggaccugacgcccaucacccagucauuaggacacuguaugaucauguggacguucggcgcgacuuuggcagauucagcgauaaaaucuuggacuuucaggaugugaacaccgucauuuuccacccgagggacgcuauccucauaagugguuccaaugauaagacugugaaacuguuugacuucucuaagacagccguaaaacgggcaaugaagacccugagcgagguuuaccccgugcgcgcucucuccugucacccugggggagaauuuuuacuggucgccacggaucauccaacugugcgacuuuacaacauugagaccgcgcaggccuaugcaucagcuaaucccgacgaucaacacagagaaagugugacagacguccauuacagcgagaacgccagguuguauguuacugcuucuaaggauggcgacgugaaaguaugggacggcguguccucacggugcgucgaaaccuucaagcgugcccacgaugggagcaguaucuguucugcaaaauuuacaaagaauggaaaauacauucugaccuccgguauggacagcaucgugaagcuaugggagcucucgacgaaccgcugccugaucguuuauacuggcgccggggcuacaggagcgcaggauuacccuaccucugcauccuucaaucagaacgaggacuucgugcuuuuuccagaugaaaaaucaggcaguauguguagcugggaggccagaaaugcugacaggaagcggcuguuggcccucggucacacuuccgcaugccgaacauucguccauucucccagcaugccggccuuuaugaccgggucagaugaccaccgcgcuagauucugguauaggaagccuacgaccaacgauaacuga

SEQ ID NO: 3461 - RNA, 1293 nt, Artificial Sequence
  Cpf1 variant
augaagcccgacaucaaagauagagaguacauguauaggcugauuauaggccaacucuucuacgacgggcaccagcagaucgccgugacccuugcuaacacacugggaugcagcgccccugcaccaccgcccuccgauaaguuguaucgguuagucacuauugcgaaacaguuuguugaagacccugauuacaaggcugaggaaaaaucucugccaaugcaguucgagacggugucaaccggucuagaccucgaauaugaugccgacguacaacccgugaguccugagccaagccaguacgagacaaucuaucugacuguccauaaggcacccugucgcgccgcugcauuuaauuccgauggcucucuuguggccaccgggucggcugacugcucaauuaagaucauggauguugaacgaauacuggcccgugagaaagaacacagagagaugaacgagaauggaccugacgcgcaucacccagugaucaggacauuguacgaucaugucgacgacgugaacaccguacucuuccacccgcgggaugcaauucugaucagcggcaguaaugacaagacuguuaaacuguuugauuucuccaagacagccgugaaacgcgcuaugaagacccucucugaagucuaccccgugagagccuuaagcugucacccugguggggaguuucugcuuguggcaacggaccauccaacugucagguuguauaacauugaaaccgcucaggccuacgcguccgccaaucccgaugaccagcaccgggagucaguuacagaugugcauuauagugaaaacgcacgccuguacguaacugcuagcaaggacggagaugugaaaaucugggacggcgucucuaaucgaugcguggagaccuucaagagagcccacgauggcuccgcuauauguucagccaaauuuacaaagaacgggaaauaucuacucaccagcggaauggacaguauuguuaagcugugggagcuuucuacgaauaggugccugaucguguacacuggugcaggcgccacaggggcucaagacuaugcgaccuccgcaaguuucaaccacaaugaagauuacgucuuguuuccugacgagaaaucgggaucuauguguuccugggaugcccggaacucagaccguaagcgccuccuggcuuuaggccauacuagcgccugcagaacauucgugcacagcccauccaugcccgcauuuaugaccgguucugaugaccauagggcccgguucugguaccgaaagccggcuacgaccgauaauuga

SEQ ID NO: 3462 - RNA, 3690 nt, Artificial Sequence
  Cpf1 variant
auggccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaaguga

SEQ ID NO: 3463 - RNA, 3903 nt, Artificial Sequence
  Cpf1 variant
augagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaaaaguuuuaagggcuggaccacauauuucaaaggguuucaugaaaaucgcaagaacguguacuccucagaugacaucccuacuagcauuauauaccgaaucguagaugacaaucugccaaaguuccuugagaacaaagcaaaguaugaaaguuugaaagauaaggccccggaggcuauuaauuacgaacagaucaaaaaggaccuggcagaggagcuaaccuuugauauagacuauaagacaucugaagugaaccagcgugucuucucccucgaugagguguucgaaauugccaauuuuaacaacuaccugaaucagucaggaaucaccaaauucaacacuaucauuggcgguaaguuuguuaauggggagaacacaaaaagaaagggaaucaaugaauauauuaaccuuuacagccaacagauaaaugacaaaacccugaagaaguauaaaaugaguguguuguucaagcagauccucucugacacggaguccaaaucauuugucauugauaagcuggaggacgauucggacgugguaacuaccaugcaaucuuucuacgaacagaucgcugccuuuaaaacaguugaggaaaaguccaucaaagagacuuuaucacuccuguucgaugaccuuaaggcgcagaagcuggauuugaguaaaauuuacuuuaagaacgacaaaagccuaaccgaucugucccagcaaguguucgacgauuauucugucauaggcacagcagugcucgaauacaucacccaacagguggcccccaagaaucuggacaacccuagcaaaaaggagcaggaucuuauugcuaagaaaacggagaaggccaaauaucugucauuggaaacuaucaagcucgcacuggaggaauuuaauaaacacagggacauugacaagcagugucgguucgaggagaucuuagcuaacuuugccgcgauaccaaugaucuucgaugaaauugcccagaauaaggacaaccuggcacagaucagucuaaaauaccagaaucaaggcaagaaagaucuccugcaggcuuccgccgaggaagacgucaaggcuauuaaagaucuuuuggaccagacaaacaaccugcuccaucgccugaagaucuuccacauaagccagucugaggauaaggccaauauucuugacaaagaugaacauuuuuaucugguuuucgaggagugcuacuuugaauuggcaaacaucgugccccucuauaauaagauuagaaacuacaucacccaaaaaccuuacucagacgagaaguucaaacugaauuuugaaaacaguacuuuagccaaugggugggauaagaacaaagagccagacaauacagcuauacuguucaucaaggaugacaaguauuaccuaggaguaaugaacaaaaagaauaacaaaauuuuugacgauaaggcgaucaaagaaaauaagggugagggcuauaagaaaauuguguacaagcuccugcccggggcaaacaaaaugcuuccuaaggucuucuuuagcgccaaauccaucaaguucuauaauccaucugaggacauauugaggauucggaaccacucgacccacacgaagaacggaaauccgcagaaaggcuacgaaaaguuugaguucaacaucgaagauugucgcaaauuuaucgacuucuauaaggagagcauuuccaaacaucccgaauggaaggauuucgguuuucgauucucagacacccagagauacaauaguaucgaugaguuuuacagggagguggaaaaccaaggguauaagcugacauucgagaauauuucugaaagcuacauagacuccguugugaaccagggaaaacucuaucuguuucagaucuacaauaaggauuucucagcuuauagcaaaggccggccuaacuuacacacucuguacuggaaggcccuuuuugacgagcguaauuugcaggaugucguguauaaacucaacggcgaggcagaacuguucuaccgcaagcaaucuauuccaaagaaaaucacccaucccgccaaggaggcuauugccaauaaaaacaaggacaauccuaaaaaggaauccguauuugaguacgaccuaaucaaagauaagagauucacagaagacaaguuuuucuuccacugcccaauaacuaucaacuuuaaaaguagcggggcaaauaaguucaacgaugagauuaaccugcuccugaaagagaaggcgaaugacguucacauccuuucuauugauaggggagaacggcauuuggcuuauuacacccugguggacgguaaaggcaacaucauaaagcaggauacauuuaauauuaucgggaacgaccgaaugaagaccaauuaucacgauaaauuagccgcaaucgagaaggaccgcgauuccgccagaaaagacuggaagaaaauuaacaauauaaaggaaaugaaggagggauaccucucacaggucgugcaugaaaucgcuaaacuggucauugagcacaacgccaucgugguuuucgaggaucuuaauuuuggcuucaagaggggucgguuuaaaguggaaaagcagguauaucaaaaacuggagaagauguugauugaaaagcucaacuaccuggucuucaaagacaaugaguuugacaagacugggggcgugcuacgcgcauaucagcugacggcucccuucgaaacauuuaaaaagaugggaaaacagaccggcaucauauacuacguuccggccggguucacuagcaagaucuguccugugaccggauuugucaaccagcucuaucccaaauacgagagcgugucgaagucccaagaguucuucucuaaguuugauaaaauuugcuauaaucuggacaaggguuacuucgaauuuagcuucgauuauaaaaacuuuggcgacaaggcggccaaagggaaguggacaaucgcuucauucggaaguagacuuauuaauuuuaggaacuccgauaagaaucauaacugggacacccgugagguauacccaacuaaagaauuggagaagcuguuaaaagauuauucuaucgaguacggccacggugaauguauaaaggcagccauuugcggggagagcgacaaaaaguucuuugcuaagcucacauccgugcugaacacgauccuucagaugcggaauagcaaaaccggcacugaacuggauuaccuaaucagcccuguugccgacgucaacggaaauuucuuugauagucgacaggcacccaagaacaugccacaagacgcggaugccaauggcgcuuaucacauugggcucaaaggacugauguugcuggacagaaucaagaacaaucaggaggguaaaaaguuaaaccucgugauaaagaaugaagaguacuucgaguuugugcagaacaggaauaacuga

SEQ ID NO: 3464 - RNA, 1071 nt, Artificial Sequence
  Cpf1 variant
augaagaccaacuaccacgacaaacuggccgcuaucgagaaggauagagaaagcgcaaggaaagacuggaagaaaauuaauaacauaaaggagaugaaggaaggcuaucucucccaggugguccaugagaucgccaaacuuguuauuggguacaaugcgaucgugguauucgaagaucugaacuuuggauucaagcggggucgcuuuaaaguggagaagcaagucuaucagaaauuggagaagauguuaauugaaaagcugaauuaccuaguguucaaagacaacgaguuugauaaggcuggcgggguucuccgagccuaucagcugacagcacccuucgaaacuuuuaaaaagaugggaaaacagacgggcaucauauacuaugugccugccgacuucaccucuaagaucugcccagucacagguuuugugaaucaacuuuacccgaaauacgagucaguaaguaagagccaggaguucuuuuccaaguucgauaaaauuuguuauaaccuggacaagggguacuuugaguucucuuucgauuauaaaaauuuuggagacaaggcugcaaaaggcaaguggacuaucgccucguucggcucacguuugauuaacuuuagaaauagcgauaagaaccacaauugggacaccagggaaguuuaccccacaaaagaacucgagaagcugcugaaagauuauaguaucgaauacgggcauggagagugcauaaaggcugccauuuaugcggagaacgacaaaaaguucuuugcaaagcucaccuccaucuuaaauucuauucugcagaugcggaacagcaaaacugguacagaacuugacuacuugaucuccccuguggccgaugucaacggcaauuucuuugacucacgccacgcuccaaagaacaugccccaggaugccgacgcaaauggggcuuaccauaucggacugaaaggccuaaugcuccuguauagaauuaagaacaaucaagaugguaaaaagcugaaccuugugauaaagaaugaggaauacuucgaguuugugcagaacaggaauaaaaguagcaagaucuga

SEQ ID NO: 3465 - RNA, 3792 nt, Artificial Sequence
  Cpf1 variant
auggaggacuacagcggcuucgugaacaucuauuccauucagaagacccugagauuugaacucaaacccgucgggaagacacuugagcacauagagaaaaagggauuccugaaaaaggauaagaucagggccgaggacuacaaagcuguuaagaaaauuaucgauaaguaucaucgggcauacauugaagagguguuugacucuguauugcaccagaaaaagaagaaagauaagacucgcuucucaacgcaauuuaucaaagagauaaaggaguucagugaguuauauuacaaaaccgaaaagaauaucccugacaaagagcgacuggaggcccuaagcgaaaagcuccguaagaugcuggugggugcguuuaaaggcgaguucuccgaagaggucgcugaaaaguauaaaaaccuguuuucuaaggagcuuauuagaaaugagaucgaaaaauucugcgagacagaugaagagaggaaacaggugucgaacuuuaagucauucacuaccuacuuuacaggguuccauagcaaucggcagaacauuuacagugacgagaaaaaguccaccgccaucggauaucgcauaauucaccaaaauuugccaaaauuccucgauaaccugaagaucauugaaucuauccagagaagguuuaaagacuucccguggagcgaucugaagaagaaucucaaaaagaucgacaaaaacauuaaguuaacugaguacuuuuccauagauggcuucguuaaugugcugaaccagaaagguaucgacgcauauaauacaauucuugggggaaagucagaagagaguggcgaaaagauccagggcuugaacgaguacauaaaucuguaucggcagaaaaacaacauugaccgcaagaaucuacccaacgucaaaauccucuuuaagcaaauccugggggaucgagaaaccaagagcuucauuccugaggccuuuccagacgaucagucugugcuuaauuccaucacggaguucgcuaaguaccugaaauuggacaagaagaaaaagucaauuauagcagaacucaaaaaguuucugagcaguuucaacagauaugaguuagauggaaucuaccuggccaaugacaacucucucgcuuccauuagcacuuuucuuuucgaugacuggucguuuaucaaaaagucuguauccuucaaguacgaugaaucaguuggugaccccaaaaagaaaaucaagaguccucugaaauaugagaaggagaaggaaaaaugguugaagcagaaauacuauaccauuagcuuccuaaaugaugccauagaguccuacucuaagagccaagacgagaaaagggugaagauccggcuggaagcguauuuugcagaguucaagucaaaagacgaugccaagaaacaguuugaccuccuggaacguauugaggaggcuuacgccaucgucgaaccacuucugggcgcagaauauccccgcgauagaaacuugaaggcugacaaaaaggagguggggaaaauuaaggauuuccucgacaguaucaagucccugcaguuuuucuuaaaaccucugcuaagcgccgaaauauuugaugagaaggaccucggauucuacaaucaacuggagggcuacuaugaagagaucgauucuauuggucaucuuuacaacaaagugaggaauuauuugacagggaagaucuacucaaaagaaaaguuuaagcugaacuucgagaauaguacucuccugaaaggaugggacgaaaaccgggaggucgcgaaucuuuguguuauuuuucgagaggaucagaaguauuaccugggcgugauggacaaagaaaacaacaccaucuugagcgauauaccaaagguaaaaccgaaugaacucuucuaugaaaagaugguguacaagcugauucccacaccucacaugcaguuaccacgcaucaucuuuuccucugacaaccugucgauuuacaaucccagcaaauccauacuaaagaucagagaggccaaaucauucaaggagggcaaaaacuucaagcucaaggacugccacaaauuuauugauuucuauaaggaaaguaucucuaaaaaugaggacuggagcagguuugauuucaaguuuuccaaaaccucaagcuacgaaaacauuucugaguucuaucgggaagucgagcgccagggguacaaucuggacuuuaagaagguguccaaauucuauaucgauagucuuguugaggacggaaaguuguaccuguuucaaauauauaacaaagauuucagcaucuuuucuaaggguaaaccuaaucuccauacgauuuacuucagaucccuguucucaaaggaaaacuuaaaagacgugugucugaaacuuaauggcgaggcagaaauguuuuucaggaagaaaaguaucaacuacgaugagaagaaaaagcgugaagggcaccauccagaguuguuugagaaacucaaguaucccauucugaaggacaaacgguacagcgaagauaaguuccaguuucaccuaccgaucucgcugaauuucaaauccaaggagcgacucaacuuuaaucugaaagucaacgaguuccuuaagagaaacaaggacauuaauauaaucggaauugauaggggcgaacgcaacuugcuguauuuagugaugaucaaucagaaaggugaaauucucaagcagacucugcuugacucuaugcaaagcgggaaaggccggccugagaucaacuacaaggagaaacugcaggaaaaggagauagaaagagacaaggcuaggaaaucauggggaacaguagagaauaucaaggaguugaaagaaggcuaucucaguauuguuauccaccagauuuccaagcugaugguggagaacaaugccaucgucgugcuagaagaucugaacauaggguuuaaacgcggacgacagaaggucgagcggcaaguguaccagaaauucgaaaagaugcucauugacaagcugaauuuucuuguuuucaaagagaacaagcccaccgagccagguggcguguugaaggcuuaucagcugacugaugaauuucagucuuucgagaaguuaagcaaacaaacaggguuccucuuuuacguaccuuccuggaauaccucaaagaucgacccccguacgggauucaucgauuuucugcauccagccuacgaaaacauugagaaggcaaaacaguggauaaauaaguucgacagcaucagauuuaacaguaaaauggauugguucgaauuuaccgccgacacaaggaaguucucugagaaucuuaugcugggcaaaaaccgcgucugggugauuugcacuaccaacguugagcgguauuuuacauccaagacugcuaauagcucgauccaguacaacucaauucaaaucaccgaaaagcuaaaagaacucuucguggauauacccuuuucuaauggucaggaccugaagccugaaaucuugaggaaaaacgaugcggucuucuuuaagagucuguuauucuauauuaaaacaacccucucccugagacagaauaacgggaagaagggcgaggaagagaaagacuucauccuuagcccagugguagacucuaagggacgauuuuucaauagccuggaggcauccgaugacgaaccgaaagaugccgacgcuaacggcgccuaccacauugcauugaaggggcucaugaaucugcuagugcugaacgagacuaaagaagagaaucuuucacgccccaaguggaaaaucaagaacaaggauuggcucgaguuuguuugggaacggaauagauga

SEQ ID NO: 3466 - RNA, 2820 nt, Artificial Sequence
  Cpf1 variant
augaaccuguacagcaaucucaccaacaaguauucccuuucuaaaacacugagauucgaguugaucccccagggcgaaacuuuagagaauauuaaggccagggggcugauacuagacgaugaaaaacgggcuaaggacuacaaaaaggcaaagcaaaucauugauaaauaucaccaguuuuucaucgaggaaauucucucaagugugugcaucagcgaggaccugcuucagaacuacuccgaugucuauuuuaagcugaaaaagucugacgaugacaauuugcagaaagauuucaagucggccaaggacacgaucaaaaagcauauaucacgcuacauuaacgauagcgagaaauuuaagaaucucuucaaccaaaaucugaucgacgcgaaaaagggacaggaaagugaucugauucucugguuaaaacaguccaaggacaacgguaucgagcuguuuaaggcuaauucugacauaaccgauauugacgaagcccuugagaucauuaagagcuucaagggcuggacaacuuauuuuaaaggguuccacgagaaccgaaagaauguuuacuccucagaugacaucccuaccaguaucauuuaccguauaguggaugacaacuugccaaaauuuaucgaaaauaaggcaaaguaugagaaccugaaagauaaggccccggaagcuauuaacuacgagcagaucaaaaaggaccuagcagaggaacucacauucgauauagacuauaaaaccagcgagguaaaucaaagaguguuuucucuggaugaagucuucgagauugccaacuucaauaacuaccuuaaucaguccggaaucacuaaguuuaacacaaucauuggcgguaaguucgugaauggggaaaacaccaaaaggaagggaaucaaugaguauauuaaccuguacucacagcagauaaaugacaaaacguugaagaaauauaagaugagcguucucuuuaagcaaauccugagugacacugaaucuaaauccuucgugauugauaaguuagaggacgauagcgacgucgugaccacaaugcagucguuuuacgagcagaucgcugccuucaaaacucuggaagagaagucuaucaaagaaacccucucccuucuguuugaugacuugaaggcgcaaaaacuagaucugucaaagauuuacuucaagaacgacaaaagucucacagaucugagccagcagguauuugacgauuauuccguuauaggcaccgcagugcuugaguacaucacgcagcaagucgcccccaagaaucuggacaacccuucuaaaaaggaacaggauuugauugcuaaaaagacugagaaggccaaauaucucagccuggagacaaucaaguuagcacuggaagaguucaauaaauaccgggacauugacaagcagugucgcuuugaagagaucuucgcuucauuugccgauauaccagugcuauucgacgagaucgcgcagaacaaaaacaaucucgcccaaauuaguaucaaguaucagaaccagggcaagaaagaucugcuucagaccuccgcagaaguggacgucaaggcuauuaaagauuugcuggaccaaacuaauaaccuccugcauaaacuuaaaaucuuccacauaacacagagcgaggauaaggccaauauucuggacaaggaugaacauuuuuacuugguuuucgacgagugcuauuuugaacucgcuaacaucguggcccuguacaauaaaauuagaaacuacaucacccagaagcccuauucugaugagaaauucaaguuaaauuuugagaacucaacgcuggcaaaugggugggacaaaaacaaggaaccugauaauaccgccauacuauucaucaaagacgacaaguacuaucucggaguaaugaacaagaaaaauaacaagauuuuugaugacaaagcuaucaaggagaacaaaggugaaggcuacaagaagguggucuauaaacugcuuccaggggcgaauaagauguugcccaaaguguucuuuagugcaaagagcauuaacuucuacaauccuuccgaggauauccugaggauacggaaccacucuacacacacuaaaaauggaucgccacagaagggcuaugaaaagcucgaguuuaacauugaggacugucgcaaauucaucgauuuuuacaagcauagcaucucccgacacccggaauggaaagacuucgguuucagauuuucagauaccaagaaauacaauaguauugacgaguucuauagggaaguugagaaccaaggguacaagcugacauuugaaaauaucucugagagcuauauugauuccuuaguggacgagggaaagcuguaccuuuuccagauauauaacaaagauuuuucagucuacagcaagggcaaacccaauuugcauacucucuauuggaaggcccuguucgacgaacggaaccuacaggacgugguauacaaacugaauggcgaggcugaacucuuuuaccguaagcaaucuaucccuaagaaaauuacccacccagccaaggaggcaaucgccaacaaaaauaaggauaaccccaaaaaggaguccauuuucgaauaugaccugaucaaagauaagcgcuuuacagaggacaaguucuuuuuccacugcccuauaaccaucaacuucaaaaguagcggggcuaauaaguuuaacgaugaaauuaaucuuuugcugaaagagaaggccaacgacguucauaucuuaucuauugauagaggagaaaggcaccucgcauacuauacucugguggacgguaaaggcaauaucauauguaagaacuga

SEQ ID NO: 3467 - RNA, 3795 nt, Artificial Sequence
  Cpf1 variant
augcuguuccaggaguuuacccaccucuacccccuuagcaagacagugagauucgaacugaaaccuaucggcaagacuuuggagcauauucacgccaaagacuuuuuaucccaagaugaaacgauggcugacauguaucagaaggucaaagcaauacuggaugacuaccauagggauuucaucgccgacaugaugucugggguugugcuaaccaagcucgcggaguuuuaugaaguauaccuggcccuucggaagacaccaaaagaugacucacugcagaagcaguugacugagauucaaaccgcucuccgcaaagagaucgugaagccgauuggaagugguggcaaauauaaggcaggguacgaucgacuguucggagccaagcuguuuaaagacggcaaggaacucggugauuuagcuaaauucgucaucacacaggagggggaaagcucccccaagcuggcacacauagcccauuuugagaaauucucuaccuauuuuacuggauuccacgacaaccguaagaauauguacucggaugaggacaaacacacagcuaucgccuacagacuuauucaugaaaacuugccuagguuuaucgacaaucugcagauucuagcgaccaucaagcagaagcacucagcacucuaugaucaaauagugaacgagcugaaugccaacggccuugacguuagccuggcuagucauuuggauggcuaccacaaacuccugacgcaggaagggauuacugccuauaauaccuuacugggagguaucuccggcgaggcagggucucggaagauucagggaaucaacgaacucaucaauauucaccauaaccagcacugccaaaagagcgagcgcauagcuaaacuuagaccacugcauaaacagaucuuguccgacggcaugggugugucauuccuacccaguaaguucgccgaugacagcgaggucugucaggcggugaaugaauuuuacaggcacuaugcccauguauucgcaaagguucaaucucuguuugaucgguucgacgauuaccgcaaagacgggauuuauguggagcacaagaaccucaaugaacuguccaaacaggcuuuuggagauuucgcccuucugggccgagucuuggacggcuacuacguggacguggucaacccugaguuuaaugaaagauucgcuaaggccaaaacagauaacgcaaaggagaagcucacuaaagagaaggacaaauuuaucaaggggguucacucacuggccagcuuagaacaggcuauagagcauuauauugcgggacacgaugacgaaagugugcaggcagguaaacugggccaauacuucaagcaugggcuagccggaguagauaacccaauccagaagauccacaauucucacuccaccauuaaaggcuuucucgagagggaacggcccgcuggugagcgugcccugccuaagaucaaaagcgacaagucgccagagaugacacagcuucgccaguugaaagaacugcucgauaacgcacugaaugugguccauuucgccaaacuucugaccacgaagacuacauuggacaaccaagaugggaauuuuuauggcgaguucggagcucucuacgacgaacuggccaagauugcaaccuuauauaacaaggugagagauuaccugucucagaaaccguucuccacugagaaguauaaacuaaauuuuggcaaccccacacuccugaaugggugggaccuuaacaaggagaaagauaauuucggaguuauauugcagaaggacgguugcuacuaccuggcgcuccuggacaaggcucacaaaaagguguuugauaacgccccuaaugcaggcaaaucagucuaucagaagaugguguacaaauuacugccagggcccaacaagaugcuuccuaagguauucuuugccaaaaguaauuuggacuauuacaacccaagcgcugaacuccuggauaaguaugcccaaggaacccauaaaaagggcaacaauuucaaccuaaaagacugucacgcacugaucgauuucuucaaggcuuccauuaauaagcaucccgaguggcagcacuuugguuucgaauuuucuccgacgagcucauaccaggaccucagugauuucuauagggagguugaaccucagggguaccaagugaaauuugucgacaucaacgccgaguacaucgaugagcugguggaacagggccagcuuuauuuguuccaaauuuacaauaaggacuucucccccaaagcgcacggaaagccaaaccugcauaccuuauauuuuaaagcccucuucagcgagaauaaccuggcuaauccuauauacaaacuuaacggcgaagcagagaucuuuuaucggaaggccucucuggauaugaaugaaacaacuauucaccgagcuggggaggucuuggagaacaagaaucccgacaacccaaagaaacgccaguucguguacgauaucauuaaggacaaaagauauacccaggacaaguuuaugcuccauguucccaucacaaugaauuucggagugcaggguaugacuauaaaagaauuuaacaagaagguaaaccaaucaauccagcaguacaaugaugucaacgugauuggcaucgacaggggagagcggcaucugcuauaccugaccguuauuaauaguaaaggggaaauccucgagcagcgcagccugaacgauauaauuacaaccuccgccaauggcacucaaaugacgacaccuuaucacaagauccuugacaaaagagaaauugagagguugaacgcacguguggguuggggcgagaucgaaaccauaaaggagcugaaaucuggguacuuaucgcacgucgugcaccagaucagccagcucaugcugaaguauaaugcgauuguagugcuugaagaucugaacuucggauuuaagcggggccgauucaaaguugagaagcagaucuaccaaaauuuugagaacgcccuaauuaaaaagcucaaucaucuggcuuugaaagacaaggccgaugacgaaaucggguccuauaagaacgcacugcaguuaacuaauaacuucaccgaucucaaaucaauaggaaagcagacaggcuuccuguuuuacgucccagcuuggaauaccaguaaaauugacccggccacugguuucguggaucuucugaagcccagauaugagaacaucgcacaaucucaggccuuuuucgggaaauuugacaagaucuucuacaacgcugacaagggauacuuugaauuuuauguggauuacgcgaaauuuacagacaaggccaaaaauagcaggcagacgugggucauuugcucccacggcgauaagcgcuauguuuacgacaaaaccgcaaaccagaauaagggugcuacuaucggcauuaacgugaaugaugaguugaaaucacucuucgcccgguaucauauaaacgacaagcaaccuaaucuggugauggauaucugucagaacaaugacaaggaauuucacaaaagccuaauguaccugcuuaaggcccuccuggcuuugagauauucuaacgcauccagugaugaggacuucauucugagcccaguagccgaugacaaaggggucuuuuucaauucugcguuagcugaugacacacagccccagaacgccgacgcaaauggagccuaccacaucgcucucaagggccuguggcuucugaacgaguugaaaaauuccaacgaucucgacaagauuaagcuggcaaucgauaaucaaaccuggcuaaacuucgcccagaacagguga

SEQ ID NO: 3468 - RNA, 3903 nt, Artificial Sequence; identical to SEQ ID NO: 3463
  Cpf1 variant

SEQ ID NO: 3469 - RNA, 3756 nt, Artificial Sequence
  Cpf1 variant
augaaccacaugaagcaguucaccaaucaauuuagccuguccaaaacacucagauucgagcuuaucccccagggcaagacuaaagaauuuauugagauaaacgggcugaucgaaaaggacaaugagagggccgugucuuacaaaaaggucaagaaaauuaucgaugaauaucauaaguacuucauugagaugguuuugugcgacuuuaaauuacacggacuggagacguaugaaaccaucuucaacaagaaagagaaggaugacacagauaagaaagaauuugacaauauacggaacucacuacgcaagcagaucgcugaugcauucgccaaaaauccuaacgacgagauuaaggagcgauuuaaaaaucucuucgcgaaggaacugaucaaacaggaucuucugaacuuuguggacgaugagcaaaaggaauugguaaaugaguucaaggacuuuacuaccuacuucacagguuuccaucagaaccguagaaauauguauguggcugaugaaaaagccaccgcaauugccuacaggcucgucaacgagaaucugccaaaguuuaucgacaaccugaaaauauaugagaagauuaaaaaggacgcuccggaacucaucagugauuuaaacaagacucugguggagauggaagagauuguucagggcaaaacacuugacgaaaucuucagcuuguccuuuuucaaucagacccugacgcaaacugggaucgagcuauacaacauugugauaggaggccggaccgcagaugaggguaagacaaaaaucaaggggcucaaugaauacauuaacacugacuauaaucagaaacagaccgauaagaagaaaaagcaggccaaauuuaagcaacuguacaaacagauccuuucugaccgccacucggucucauucguggcugagacauuugaaaccgaugcccagcuguuggagaacauagaacaauucuauagcaguguacucuguaauuacgaggacgauggacauacgacuaacauuuuugaggcgaucaagaaucugaucauuggcuuaaagacauucgaccuguccaaaaucuaucucagaaacgauaccucucuuacugacauuagccagaagcuguuuggcgacugguccauaaucucaagugcauugaaugauuacuaugaaaaacagaaccccauuagcucuaaggagaaacaggaaaaguacgacgagaggaaagccaaguggcuaaagcaagauuucaauaucgagacaauccagaccgcucugaacgaaugcgacuccgagauuauaaaagaaaagaauaacaaaaacaucguuucagaguacuuugccaagcucgggcuggauaaagacaauaagauugaucuucugcagaagauccaccacaacuauguggucauuaaagacuugcucaaugaaccuuacccagagaacaucaagcugggaaaucagaaagagcaagugagccagauaaaggauuucuuagacaguauccugaaccuaauucauuuccucaaaccccugucucuuaaggauaaggacaaagaaaaggaugaguuguuuuauucccuguucacggcacucuuugaacaccugagccagaccaucucgauuuacaauaaagugcggaacuaucuuacacagaaggcuuacucuacugagaaaaucaagcugaauuucgaaaacuccaccuugcucaaugguugggacgucaacaaggagccuguuaauacaucagugauauuucgcaaaaacggccuguucuauuuagggauuaugaguaagagcaauaaccgaaucuuugagagaaacguaccaguguguaaaaaugaagagacugccuucgaaaagaugaacuacaaacugcuacccggagcgaauaagaugcucccuaaagucuuucuguccgccaagggcauugagucuuuccaaccaagcgcagaaauccagucaaaguaccagaaagagacccauaagaaaggugacgcuuuugugaggaaggauauggagaaccuuauagacuucuuuaaacagaguaucgccaagcacacagauuggaagcacuucaaucaucaauucuccaaaaccgaaacuuauaacgacuugagcgaguuuuacaaggaaguugagaaacagggguauaagcugacguucacaaaacucgaugagaccuacauuaaucagcugguggacgaaggaaaguuauaucuguuucaaaucuacaacaaggauuucucuccguuuucaaaaggcaagcccaauaugcacacucuuuauuggaaaauguuguucgacgagcagaaccuccagaaugucguguacaagcugaacggcgaagcugagguauuuuuccggcagaguagcauuaaacaaaccgaucguaucauacauaaggccaaucaggcaauugacaacaagaauccucuaaacaacaaaaagcaguccucuuuuaauuacgaucugaucaaagacaagcgcuucacacucgauaaauuucaguuccacguuccaaucacccugaacuucaaggccgaagggaaugaguaucuuaacacuaaggugaaugaguacuugaaaucgaacagcgacgucaagauuaucggacuggacagaggugaaaggcauuuaauuuaucucacacugauaaaucaaaaaggcgagcuucugaagcagcaguccuugaacgugaucgcuacgucacaggaacacgagaccgauuacaaaaaucuccuggucaacaaggaaaaugagcgggcgaacgcacgacaagacuggaaaacuauugagacaaucaaggaacuaaaggagggguaucugagucaggugguucaccagauugccaccaugaugguggaugaaaaugcuaucguagucauggaggaccucaacgccggauuuaugcgcggcagacaaaaaguggaaaggcagguuuaccagaagcuggagaaaaugcuuauagagaaguugaauuaucugguguucaaaaacaaugaugucaacgaaacagccgguguguuaaacgcacuccagcugacuaauaaguuugagucuuucgaaaagauggggaaacaaagcggcuuucuuuucuacguacccgcuuggaacaccuccaagaucgacccugccacgggauuuguggauuuccugaaaccaaaguacgagucaguugagaaagcaaagcuauuuuucgaaaaguuugagagcauuaaauucaaugcggacaagaacuauuuugaauuugaguucgauuacaaaaaguucaccgaaaaagcugagggcucucagacaaaguggacugucugcacccauuccgacgugcgguaucgcuacaauccccagacaaaggccagugaugaggugaacgucacuaaugaacucaaacugaucuucgacaaguuuaaaauugaguauaagaacgggaaaaauuugaagaccgaacuguuacuccaggacgauaaacaacuguucagcaaacuucugcacuacuuggcacucacgcugaugcuaagacagucuaaguccggaacagacaucgauuuuauacugucaccgguugccaagaacgguguguucuaugacaguaggaaugcuaugccuaaccuucccaaggaugccgacgcaaauggcgcuuuucauauugcccucaaagggcuguggugugugcagcagaucaagaaagcggaugacuugaagaagaucaaacuggccauuagcaacaaggagugguuaucguucguacaaaaucucaaauga

SEQ ID NO: 3470 - RNA, 4173 nt, Artificial Sequence
  Cpf1 variant
augaucgacaacaccaaggagaaaaaggaaggcagcguguucgauggguuuacaagaaaauaccagcuguccaagacucucagguucgagcuucggcccauucugaauacgccuaaaauguuggacgaugaacaagucauaaagaacgacgagacccgccgaaagaaauaugaagccguuaagccaugguuugaucaguuacaccgugaguucaucgaggacgcucugaaaucuuuuaaguucaaaaaucuagcaauuuaccaggauacauuucagacuuggcaaaaggacagaaagucaaaacagaagaaagauacccucgugaagaucgaaguaggacugagggaggaaauugugcggcgcuucgaggaggucgccaacaucugggugagaagugaacaguauaaacuucuggguauaaagaaagagggcuuggggaugcucuuugaagcgggaguuuucaggcugcugaaggagcgguuuaagaaugaaaaagacacaaccguggauggcaacaauaucuucgacgaguggacucgcuggacagguuacuuuaagaaauucuucgagacccgaaagaacuuuuauaaaagcgaugacacguccacugcuauugccuacagagucaucaaucagaaccucaggcgguucugcgaaaauauucaaaucuuugagaagauaucugaaaagauugaguucucggaaguggagaaaucauuugacaucagcugugcagggauuuucaguuuagccuauuacaacgcuugccugcuucagggaggcaucgauaccuacaauaagaucauuggcggggagguagacgaaaaagauaagaaaauaccgggaaucaacgaguugauuaauaaguaucgucaggacaacuccggugaaaagauccccuuucugaaacagcuagauaagcaaauacauucugcaaaagaggccuucauugaaagcaucgagacaaacaaggagcucguuggcaaacugaagacuuuuuacgaaaaugcugaggugaagauccaguccuuccgcaaccuuauugccgacaucgucaccgauuauucaggguacgacauugauaaaauauaucugacaaaggaagcggugagucacaaugcaagcagaugguuugccucuuucgaguccuuugagagggacuuguucgcuguggucgccgaaaaacagaacaagcucguuuacgagcuguuacggacccauaaaaaugauucaaagaucagcgacaaagacggaaaguucaguuuuccugauuucauuaaguguucucacaucaaacgagcacuggaaaagcaagagggccgcaucuggaaaggugaauauuacgaggacauuguggauuuugagaagauaaaagacguauucacgcaguuucucugcguguucaaguuugaacuugagcagcaguucuuuagaaagacuacauccgcucaaaccggggaacagacuaaaaucggauacgagauuuucgucacaaagaucaacgaacugauuaccagggagaauccagugaucgauuuggaggagaaaauagccaucaagaacuuugcggacgccacgcuacugauuuaucagaucgcaaaauacuucgcuguugaaaagcggcgcggcuggcucgauaauuaugaccuggaugacagauuuuacaagagcucggauauuggcuaucuuaacuucuacagggacgccuucgaacagaucgugcgucccuauaaucuguuucggaacuacuugaccaaaaagccuuacaauacaaacaaauggguccucucuuucgagaauccaacucuggcugaugggugggacaagaacaaagaaaagaccaacgccgcagugauauuacgaaaggacggaagauauuaccuggguauuaucaaagaggauuguaagucccuauuugccgacagguauucaaaagagaugagugaaggcauugagagcggguccuuccaaaagauggcuuacaaauuuuuccccgaagcgucuaagaugaucccuaaaugcagcacacagacuaagaauguaaaggagcauuuucgcaaaucaaguuccgauuauaaccucuuccacgagaaggacuacaaaauaagcguugcaaucaccaagaauauuuaugaacugaacaauguguuuuaccggaaagauaacaucgaggaaucuuucgucccaaagaaugacuuugagaagaaacuuggagugaagaaauuccagagacaguacuuggaaauuucaagggauaacaauggcuauaagcaagcccuggcucaguggaucgaguucuguauacgcuuucucaaagccuacaagaguacaaccauuuucgacuauagccgacugcgggaggcaaaggaauacgagucccuugaugccuuuuaucaggacaucaacgcucugacuuacaauaucucuuucgucccgauuucggaacaguauaucaaagagaagaacgauaauggugaauuguuucucuucgagauuuacaacaaagacuggagccuggggcccauggauaagaaucguaaaagaacgaagaacuuacacacacuguacuuugagcaacuauucuccaaggaaaacgagcaggaaaauuuucucuuccagcugaacggcgaggccgaacuguuuuucaggccuaaaaccgaggagaagcgcuugggauauaaagugugggacgcaggcgaaaagaaauggguuaaggcgaaggagaaagaagacggggcugugauagaucggaagagauacgccaaagacaucauucuguuucauugcccaaucacucucaauaggguaucagagaguaagaccaaacgagagauggaugucgaaauucgcgaggugcugucuagcacacccggaguucacaucauagguguggaccggggcgaaaagcauuuagcauauuacuccgucaucgaucaaaacgggaaaauuaucgagaccgacacucuuaauucaauuggaaaggauggcagagguaagccuguggaauaugccagcaaacuugagaagagggcucaggagcgugaagccucucgccgggacugggaggaaguagaggcaaucaaagauuugaagaaaggguacauaucccaggugauuagaaaccucgcugaccugaucaucaagcacaaugccauuauaguuuucgaagaucuaaacaugagguucaagcagauccgaggcggaauugagaaaagugcguaucaacagcuggagcgggcccucaucgacaagcugagcuuucuugucaaaaagggcgaagaggacccaaaacagacagggcacauuuugcgcgcuuaccagcuggcagcccccgugaucgcuuucaaggauaugggaaagcaaacggguuuaauauuuuacacccaggccggcuauacuucuaaaacauguccggaaugcggguacagaaggaauaucaagugucucuucgagaacauugaacaggcaaaaacccugaucgagaaucuugaguccauuaacuauaauaagaaagaagacguguuucagaucucauacagucuggagaaguugagcucgaaggaucagaaaaaggagaaaaaggucuccaacgaacucuaugcgaaaacacugaagaaagacauauucauucuaacuaccaagaaugcccugcgguacaagugguaugaucgauacucugagaaagcuaagguugccaaaagaggaaucgacgaauacaagggcgaggugaacgaaagcgagacgaaaaagggugugguaaaggaauuuaaccucaccgaguaucugaaagggcuuuugaagacauacgagaucgauuaugaacauggcggcauucgcgagcaaauccugucagucgcaaggggacgugaguucuacaaagacuuuuuauaugcucucuuccugcuuacugaaacccggcacaguauauccgggagaaauacagauuacauucagugcccugaaugcgaguuugacucuaggaagggauucaaagauaucaaggaguuuaacggcgacgccaauggugcauauaacauugcccgcaaggggaucaugauacuggaaaagauuaaacaauucaaaaaggauaaugacggaaaccuagagaaaaugggcuggggugaccucagcaucuccaucgaagagugggauaaguucacucagaaggaauga

SEQ ID NO: 3471 - RNA, 4026 nt, Artificial Sequence
  Cpf1 variant
augaacgccgagaagaaaugcgcuuucaaugaauuuaccaaccuguacgagcucagcaagacacuuaaauucgaacugaagcccgugggcaaaacuaaggagaucauuaagaauuuuagagaagaguuggagaaaaacaauccuauacaguuagacaaggaaaucuccauugcaaaacaagagaucaagaaagaucuggacauucuacacagggaguucguccggcagucuuuugaacucgccuucaaggagaacaagaucaauuaugaaauauuuuucgagaucuaccgcaacuuuaaaaaguucucaaagaauaagaaaagugaugaauauauugcggcuaucaagaaccugaaagaggaaaagauuaaacuuguuaaaaagaucgccgacuacuuugugaaaauggaucaggaguggcgaaaguauuacccaagcgagaaaaaguccuuccuguugaugucuaaugggguaauaaaccuccugauugacaucaauaaggaucguauggacuauucguuuauuccgaaagaagugugugagaagaucaaaggaaaggguaaaaucgaacuguacgagaaguucaacaagcauuucggcuaccucucaaaauauaauacggcaagagaaaacuuuuacagcgaugacgucaagaacagugccuccguggcuuauagggcaauuugcgagaauuuagagaaauucugugauaacaagauaaaaguugaagccgacaauuuucccaaggagaucaaggaaaaauuccuggaguacuuuaacaagauuaccgaucuuucuuucuauaaucggugcuugagccagaacgggaucgaagaguaccacaaauuuaaggacgagauaaaucgcuccauuaacgaacuguauccuaauaacaguaaaaauaagccacaaaacauccccuaccuaaguaaacucgacaagcagauccugagcgagaaggauaaacagucuuggauugaagagggauucaucgacgagaauaacuuuauuuucgaauuugagaaguucauaaaaaugaaugauaaguacaucccuuccgaaaagaaacuuuuuaacgaguucuucauuuuucagaacaaugacgaagugcugcaaaaguuguuccuccugaaaaagacaaucaacaauuuugcuaacaucuauuuagaugacccaaagaaucugauggaucucaugcccucaaagggcacuaaaaagagagacuaccuuagccuguuggagauuaaggaggcccuaaacaguuaugcggaaaaucagaacauaggugagacccagaucuucaaaauuaaguacgaugacgucaucgauaaaacaaagaccccuuuugaauguuucaugaaaauuuggaaguaugaguacgaccugcucuauaaugaaggggacggaaagaaaaacaucgaggagggcugggaaaagauaugcgagaaacugcagaauaagaaagaugaauuuacuggcgacuacgggaaguacaaaaaggagaucaaggauuauugugaaauggcacuuucucugucccaaaggauuaaacauuuggacauccggauuaagaaacgcgauggaagcgaggacgccgauaacaaucucuucgaggguguggaaaagcuggacgaguuuuacgaucgauuauucgaaaucguagacgagcacaacgcuuaucaguaccaucacgaguuucaggccuuccugaccaaaaagccauauaagacagauaaauuuaagcuaucguucgacaauccgcaacuccugaaaggcugggaucuuaacaaggaacccgacuacuucggggcauugcugguuaaaaacgagaaguauuuucucgcuguguuccacaagcaguacgccaaugaaauauuuagacagaaaaacaaaaauucuacggucaaaauuaaggaggcguacgacguguucaacggaaauuauuacaaaaagguggaacugaagcagaucccuaaacuuuuuaugaaccugccaaggauuugcuucgccaaguccaaucaagaggaguuuggcuugacuaucgaacucgagaaaauaaagucagaguucgauaaauuucagaagcugaagaaagaacggcaggacaacaauuuaaaguucgaucaggaaaaauuuaucaagcugcuagcauauuaccgucauugucucgagauucgcgaggacuggaaagucuucaaguauaacuucaaaccccuguacaaguauaguaaucuuggugaauuuuacagagauuuggagaaggacaccuacaaccuggaucucguuagggugaauagcgaauauguagagaaaaagcggaacgaagggaaacuguacuuauucgagguguauaauaaggacuuuuccgauaaaucuaucggacgaaagaacauucacagcgacuacuucaagucacuguuucuuccugauaacuugacaaauaaaaagaucgcucucgccgcugacgccgagauauucuuucgcgaaaaaucacugaagaacaaagaugagauuaucacucaaaagaauaagaucaaaauugacaagaacaaucauaaaggcgaaaaggcauauuccaaaaacagauacaccgacgauaagaucauucuacaucugccaauaaaucucaacuucggcgagaauaagaaccacaaagacuuuaauuaugagaucaacgauagccugcuuaagaauaacagggacauuaaaaucauugggaucgaucggggagaaaaguacuugcuguacuauucugucauagaccagaaaggugauaucaaggagaugggcgacuucaaugugguuaacgggguggauuacuauucaaaauuagucgccuacgaagagaagcgcaagcaggcuagacucgacuggggagauauucagaguaucaaagaacugaaggagggcuauauuagccacgugauccacgagauaugcgaccuuauuaaaaaguacaaugcgaucguaguucuggaagacuuguccauggguuuuaaaagggggcguuucuuucgggagcgacaaguguaucagaaguucgaacucgcacuguucagaaagcuaaacuacugggucgauaaaaacaaggaggaaggcgagaaaggaucugcccugucggcuuggcagcucacacccaaugagaaggacuuuaaagugagccagcuggaaaaggccaggcaacuuggcaucuuguucuacaccgcagccggguauacguccaagacuuguccggauugcggauuucgcaaaaacauuacacugaaguacgucaaugacaaacaguuaaaggaggaucucgguaaacugaagauaaacuucguggaagaccauuuuaagaucaaauauaaucuucuggauuucgagaagaacaaaaagucagaaaaagcuaaggacaccguucuaccuaaagaggagcggaagauuaguuuuguggccaauucuaagguaaucagaauuagguggcacgauaucaaaacuaagcucgcaaaacgcgaacuggacggcgagaagauaaucaaaaaguuccccaagggggucauuaaagaauacgauaucaacauuugcuugaagcgaaucauaggagacaaaauugauuuuagcaaggacuccaucacagagcagcugaucaauggccgguucgguaaagacuuuuauugggaguuaauguacuuccucaaccugauucuugaaauccguaaugugguuucagagaccgaaauagauuauauucaauguccagugugcggguuucauagcgacgauggcuucagaggaaacaaguucaauggcgacgcgaacggggcuuacaauaucgccaggaagggacgccugauuuuggagaaaaucaaccagcacaagaaccucaaagaacugaagacgggugaucuaucugucaauauaguggagugggacaaagcaguaaacaauugggauaaguuugugcagggcgacaacaccgaguccaagaauauugaaaucccugccaaagaggaaaugaucaguguugagguccgggaaagcuga

SEQ ID NO: 3472 - RNA, 4107 nt, Artificial Sequence
  Cpf1 variant
augaagaaagagaaggaguucaagagcuuuggcgacuucaccaaccuguacgaaaucuccaaaacacucagauuugaacuuaaacccguggagaauacucagacgaugcuggaugaagccgacgucuucgggaaggauaagguuauuaaagacaaguauaccaaaacaaagccuuuuauagauaaauugcacagggaguucguggacgagucuuuaaaggauguaucacugaguggacuaaagaaauacagcgaagugcucgagaacuggaagaaaaauaagaaagacaaggauaucgucaaagaacugaagaaggaggaggaacggcuucgcaaagaggugguugaauuuuucgacaacacugcuaagaaaugggcaaaugagaaguauaaagaacuggguuugaagaagaaagauauuggcauccucuuugaggaguccguguucgaccugcugaaggaaaaauacggggaggaacaagauucuuuucucaaggaggaaaaaggagacuucuuaaagaacgagaagggcgagaaagucucgauuuuugacgaauggaaggguuucgugggguauuucaccaaauuucaggagacacgaaagaauuucuacaaaaacgauggaaccgaaacugcccuggcgacacguaucauagaccagaaucuuaagagauuuugcgauaacaucgacgauuucaagaaaauuaagaauaaaaucgacuuuucagagguagaaaagaacuucaauaaaaccgcugauguuuuuagcuuggacuucuauaaccagugucugcuacaaaagggcauugauaguuacaaugaguuuaucggcgggaaaacgcucgagaacggaaagaagcugaaaggugugaacgaacuugucaaugaguacaggcagaagaacaaaaaugaaaagguguccuuccugaaauugcucgacaagcagauacugucugagaaggagaaacugagcuuuggcauugaaaacgaugagcaguuacucgugguccuuaauuccuucuaugaaacugccgaggaaaagaccaaaauccugcggacauuguuuggggacuucguugagcauaacgagaauuacgaccuagauaagacuuauauuucaaaaguggcauucaacaccaucagucacaaguggacaaaugaaacccauaaguuugaggaacugcucuacggagccaugaaagaggacaagccaaucggccugaacuaugauaaaaaggaagacagcuacaaauucccggauuuuauugcucuugguuaucugaagaagugcuugaauaaccucgacugugauacgaaauucuggaaggagaaauacuacgagaauaacgcagacaagaaagauaaggacaaaggguuucugacuggaggccaaaaugccugggaucaguucuuacagauauuuaucuucgaauuuaaccagcuguucaacucugaggcuuuugacaauaagggcaaggaaauuaaaaucggguaugauaacuuccgcaaggacuuugaggaaauaauuaaucaaaaagacuucaagaacgaugagaaucuaaaaaucgccaucaagaacuucgcggacuccguacucuggauuuaccagauggcaaaguauuuugccaucgagaaaaagagaggaugggaugacgauuucgaacugucagaguuuuacacaaaucccagcaacgguuauagucuuuucuacgacagggcuuaugaagagauugugcagaaauacaaugauuugcggaacuaccugaccaagaaaccuuauaaggaggacaaguggaaacucaauuuugaaaacccaacucuggccaauggcuucgauaagaacaaagagucugacaauuccacagucauacuucgcaagaaacgaaaguacuaucugggguugaugaagaaaggaaacaacaagaucuuugaagauagaaauaaagcagaguucauuaggaacaucgaaagcggcgcuuacgagaagauggccuauaaauaccuccccgacguggcgaagaugaucccuaagugcucgacccaacugaaugaggccaaaaaccacuuucguaauucugcagaugacuuagaaauuaagaaauccuucucaaacccacugaagauaacgaaacggaucuuugaccuaaauaacauucaguaugauaagaccaauguuaguaaaaagaucagcggugacaacaaggggauuaaaaucuuccagaaggaguacuacaaaauauccggcgauuucgacguguauaagucugcucucaaugauuggaucgacuuuuguaaagauuuccugagcaaguacgacucaacaaaggauuuugacuucaguauucuucgcaaaacuaaggauuauaaauccuuggacgaauuuuacgucgacguggccaagaucaccuauaaaauuagcuucacacccguaucugagucauacaucgaucagaagaacaagaauggagaacuguaucucuuugagauauacaaccaagacuucgcuaaaggcaagaugggggccaaaaaucugcauacuuuauacuuugagaacguuuucaguccugaaaacauuagcaagaauuuuccaaucaaacugaacggaaaugcagagcuuuucuuuagaccgaaguccauugaaucuaagaaagagaagaggaacuucgugcgggaaaucgucaauaaaaagcgauauucggaggauaaaauauucuuucacugccccaucaccuugaaccgcgagacagguagcauuuacagauucaauaacuaugugaauaacuuucucuccgaaaauaacaucaauauuaucggcgucgacaggggagagaagcaccuggccuacuauucagugauagauaaaaacgggguuaagauuggcggugggaguuucaaugaaaucaacaagguggacuacgcuaaaaagcuagaggagcgggcgggcgaacgcgagcagucuagaaaagauuggcagguagucgaaggaaucaaggaccugaaaaagggcuauauuagccaggugguuagggagcucgcagaucuggccaucaagcauaaugcuauuauagugcuugaagacuugaacaugcguuuuaaacaaauccgagggggaauugagaaguccaucuaccagcagcuggagaaagccuuaauugauaagcucucauuccuggucgaaaaaggugagaaggacccuaaccaggcaggccacauccuuaaggccuaccaacuggcugccccauuuaccagcuucaaagauauggggaagcagacuggaauaguguuuuauacgcaggcaucuuacacauccaaaaccugucccaauugcggcuuccggaagaacaauaacaaauuuuauuucgaaaauaacaucgguaaggcgcaggacgcuuugaagaaacucaagacuuuugaguacgacagugaaaauaaauguuucgggcugagcuauugccuaucugauuucgccaacaaggaggagguagagaaaaauaagaacaaaaagagaaauaacgcaccuuacuccgacauugaaaagaaagauuguuuugaacugucaaccaaggacgccgugagguaucgcuggcaugauaaaaauacagagcggggcaagaccuucuuugaaggagagaguguuuacgaggaaaaagaggaaaaggagaucggccaaacuaagagagggcucgucaaagaguacgacauuagcaagugccugaucggacuuuucgagaaaacaggcuuggauuauaagcagaaccuguuagacaaaauaaauucggguaaguuugaugggacguucuacaagaaccucuuuaacuaucugaaucuucuguucgaaauuaggaacuccaucucuggaaccgaaaucgacuacauuagcugcccagagugucaguuucacacugauaaaucaaagacaaucaaaaauggcgacgauaacgguaguuauaauauagcucgcaagggcaugauuauccuagacaaaauuaagcaauucaagaaagaaaacgggucccucgacaagaugggauggggcgagcuguuuaucgauuuggaggaaugggacaaauucgcccagaagaaaaauaacaauauaaucgauaaguga

SEQ ID NO: 3473 - RNA, 4149 nt, Artificial Sequence
  Cpf1 variant
augagcaagaacaaugugugggacaaauucaccaaccaguacucccugucuaagacacucagauuugagcuuaaacccgucggcaagacuagggaaaagaugaaugagcaacugaaguaugauaagcaguugcagacguucuuaaaagaccaggaaaucgaggaugccuaccaauaucugaagccauuuuucgacaaacuacacaaggaauuuauuaccgauucacucgacagugauacaacuaaaaagauagacuucagcgauuaccugaucgacuaucgggauaagaaagaccuuaccaagaaagaggauucccugcgcaagaacauuggggagguuuuugugaaagcuggagaccgauggaagaaagaaaaguacccuaaguaugaguggaaaaaggguucuaauguagcaaacggcucggggaucuugcucacacaggacgugcugaugcugauuaaagaucucaauccgaacgaccagaagaucaaaaagaugauagaagagaccuucaagggauuuuucacuuacuuuucaggcuucaauuuaaaccgugagaauuacuauacaaccaaagucgaaaaggccacggcgguggcuacuagaaucguucaugauaaccugcccaaauuuugcgacaaucuugugcaguucgaguguauuaucaagaaaaagaagaacggugaagucgauaggauugagcggaaaagcgaauacuugaaugccuaucaauaccugaagaguaaagggcgcaccacacagaucaaggacgcagaguccggaaaaaugauagaggccgaagugauuaacgagaacauguucucuaucagcuauuuuuccgcuugccuaucacagaguggcauugaagaguacaauagaacuaucggccacuauaaccuccugaucaaucuuuacaaccaggcaaaggaaggggaggagaaggaucugaaaaagagcgaaaagaaguucaaaagguugccuauuuuuaagacccucuacaaacaaauaggauguggugagaaggaaccacuguucuuuucuuuaacacaugacaccaagcugcagguacaggagaauaaagaaaacuauaagaaacccuacuccguugagcaaauccucgagcaggccaaacuugcuggcgauaaauauuucaaggggaagucaaaugacggcauucugaacacgaucccugaauuuagcgauuacauauugcagaaagagaguuauggagguguguacuggucuaaggucgccauuaauacuaucuccaaccgguauuucgaaaauuggcacacacuaaaagacgcgcugaucgacgcaaagguguuugagaaagggaagaagggagaugaggaagacgugaaaauuccagagagcaucgaacuccagggcuucuuugauguccuggacacccaagagggcuggaagucggaagggauuuucuuuaaaaagucucuuacugaggagcugaaaaacaaggaagccgauacaaagaauaaaaagcgccgagagauaguuaaagaagcuaagagacccucccaggccuugcucgcacuguuauucgacgauauccaggagcaugcuaaccuguuccuaaaucagucagacgaaauucucaaacuggagaaguacagugagaaagaaagcaaggagaagaucaaacaauggauggauuccgcccuugcggugaacaggaucuugaaguacuuuuucguaaaagaaucuaaggccaaaggagagcagauugacccuauaaucagcgaagcacugaaggugcucuuuaacucagaggaugcuaccugguucaagugguaugacgcccugcggaauuaccuuacgaaaaagccacaggaugacgucaaagagaacaagcugaaauugaauuuugaaaacaguacccucgcugguggcugggacauuaauaaggaguccgauaacuauugcgugauccugcaggaccaaaaggggaaacagcacuuaggaauuaucgccaagaaagaaaagcagcguggcuacaauaaaauauucgagcgcacaccggagaacccccuguauaagaucgauagcggugaaguuuggcagaagauggaguacaaacaaauugcagugccuacugggaucggcggauuugucagaaaguguuucaauaccgcccagcaguauggcuggaaaugcccagacaacugucuaaauucugaagggaagauuaucauaaagaacgaugaggcuaaggaaaaucucgaggcgauuaucgacugcuacaaggacuuuuucacaaaauacgagaaggauggauuuaaauauaagaacuucaauuuuaacuucaaagaaucagaggaauacgaggaacugaacaguuucuuuagcgauguggagaggcaagguuauaaacuuggcuucauuacuguaaauaaaaccaucauagacaaguggguugaggaugggacaaucuacuuguuugaaauuaagaaccaggacaccaaugauggcaaaaaggacggacacaaaaacaaucugcauacuaucuauuggaaggcacucuucgaggacguggguaacaaacccaagcugaaugggggcgccgaauuauuuuaccggaaggcucugcuuaaagauaagcaggagaaaauugaagacaacuauggaaaggagaucauuaaaaauuuccgauuuuccaaggagaaguucuuguuucacuguccuauaaaacucaacuacaaggccaaaucuuacucgcauccaaaguaugcacugcccgaaaucaauaaacagacgaacgaguucuuuaucacaauuagcgauaucugcuuccuaggcauugaccgcggggaaaagcaccuggccuacuauucccucgucaaucaaaaggaggagauaaucgaucagggaacccugaacaugccguucguggacaaagaugguaagccuagaucaauuaaaaaggaaaaauuuagguucgacgcuaaggucgauaaaugggugagugaggaaauggacuguuggaauuacaacgaucuuuuggacgccauggcaucuaaccgggacauggcgcgcaagaauuggcagacuaucggcaccauuaaggagcugaaaaacggguauaucagccagguugugagaaagauaguagauuuagcuaucgacaaaaauaggggcauucccuccuuuaucguccucgaaaaccugaaugccggauucaugcguggucggcaaaagauugagaaaucaguguaccagaaacuugagcuggcauuggccaagaaacucaacuuuguuguggauaagacaguccagaauggggaaaucggcagcgugaccaacgcucugcagcuaacuccaccuguaacaaauuuccaaaacauagagaaucgaaaacaggugggaauuaugcuguauacgagagccgacuacaccucucagacugaucccguuacaggcuggaggaaguccaucuaccucaaaaaggggagugaagaguauaucaagagccaaauuauggacucuuuugaugacuucggauuugauggcaaaaacuacuauuucaaguacaccgucgaccugauagauccaaucaaaaagacauccgagaaaaaguuuaagaaacaguggacucuuuauucagguauuaaugggaagaguuuggaccgcuuccggggagaaagaagcucggauaaaaacguguggaucaagacccugcaggacauuaaaacgaccuuagacgcaguguuuaucggcuucgaucuccagcacucccugaggucucaaauaaucaaugacgguauuaugcccaagaaaaucgagaacagccaguucacaggcugggaaucacuucgcuuugcuauugagaugauccagcagauacgaaauauuggggucgaaaagggagaugaggacuucauccugaguccuguucgggauaagaacgaaaaccauuuugacucccguaaagccaaggagaaugagccaaacucuggcgaugcgaauggggccuacaacaucgcuagaaaaggaauuaucaugaaugaacacauaaagaaagaccuaauuccguucauccaagauaaggagugggacgcauggcucgccggcagggaagugugggauaaguggcugauugagaacaaagacagcuugaucuauaagaaauga

SEQ ID NO: 3474 - RNA, 4203 nt, Artificial Sequence
  Cas9 variant mRNA product
auggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaauga

SEQ ID NO: 3475 - RNA, 4986 nt, Artificial Sequence
  Cas9 variant mRNA product
auggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaaguga

SEQ ID NO: 3476 - RNA, 3258 nt, Artificial Sequence
  Cas9 variant mRNA product
auggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaauga

SEQ ID NO: 3477 - RNA, 4326 nt, Artificial Sequence
  Cas9 variant mRNA product
auggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaauga

SEQ ID NO: 3478 - RNA, 3402 nt, Artificial Sequence
  Cas9 variant mRNA product
auggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaauga

SEQ ID NO: 3479 - RNA, 4263 nt, Artificial Sequence
  Cas9 variant mRNA product
auggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaauga

SEQ ID NO: 3480 - RNA, 3345 nt, Artificial Sequence
  Cas9 variant mRNA product
auggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaaguga

SEQ ID NO: 3481 - RNA, 4101 nt, Artificial Sequence
  Cas9 variant mRNA product
auggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaauga

SEQ ID NO: 3482 - RNA, 4134 nt, Artificial Sequence
  Cas9 variant mRNA product
auggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaaguga

SEQ ID NO: 3483 - RNA, 3267 nt, Artificial Sequence
  Cas9 variant mRNA product
auggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaauga

SEQ ID NO: 3484 - RNA, 3345 nt, Artificial Sequence
  Cas9 variant mRNA product
auggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaaguga

SEQ ID NO: 3485 - RNA, 3351 nt, Artificial Sequence
  Cas9 variant mRNA product
auggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaauga

SEQ ID NO: 3486 - RNA, 3051 nt, Artificial Sequence
  Cas9 variant mRNA product
auggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaauga

SEQ ID NO: 3487 - RNA, 3462 nt, Artificial Sequence
  Cas9 variant mRNA product
auggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaauga

SEQ ID NO: 3488 - RNA, 4020 nt, Artificial Sequence
  Cpf1 variant mRNA product
auggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaaguga

SEQ ID NO: 3489 - RNA, 3999 nt, Artificial Sequence
  Cpf1 variant mRNA product
auggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaauga

SEQ ID NO: 3490 - RNA, 4716 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3491 - RNA, 5499 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3492 - RNA, 3771 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3493 - RNA, 4839 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3494 - RNA, 3915 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3495 - RNA, 4776 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3496 - RNA, 3858 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3497 - RNA, 4614 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3498 - RNA, 4647 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3499 - RNA, 3780 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3500 - RNA, 3858 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3501 - RNA, 3864 nt, Artificial Sequence
  Cas9 variant mRNA product
gggagagucccgcagucggcguccagcggcucugcuuguucgugugugugucguugcaggccuuauucaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3502 - RNA, 3564 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3503 - RNA, 3975 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3504 - RNA, 4533 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3505 - RNA, 4512 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3506 - RNA, 4813 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3507 - RNA, 5596 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3508 - RNA, 3868 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3509 - RNA, 4936 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3510 - RNA, 4012 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3511 - RNA, 4873 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3512 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3513 - RNA, 4711 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3514 - RNA, 4744 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3515 - RNA, 3877 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3516 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3517 - RNA, 3961 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3518 - RNA, 3661 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3519 - RNA, 4072 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3520 - RNA, 4630 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3521 - RNA, 4609 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 3522 - RNA, 4497 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3523 - RNA, 5280 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3524 - RNA, 3552 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3525 - RNA, 4620 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3526 - RNA, 3696 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3527 - RNA, 4557 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3528 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3529 - RNA, 4395 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3530 - RNA, 4428 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3531 - RNA, 3561 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3532 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3533 - RNA, 3645 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3534 - RNA, 3345 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3535 - RNA, 3756 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3536 - RNA, 4314 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3537 - RNA, 4293 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3538 - RNA, 4439 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3539 - RNA, 5222 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3540 - RNA, 3494 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3541 - RNA, 4562 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3542 - RNA, 3638 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3543 - RNA, 4499 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3544 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3545 - RNA, 4337 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3546 - RNA, 4370 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3547 - RNA, 3503 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3548 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3549 - RNA, 3587 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3550 - RNA, 3287 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3551 - RNA, 3698 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3552 - RNA, 4256 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3553 - RNA, 4235 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3554 - RNA, 4420 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3555 - RNA, 5203 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3556 - RNA, 3475 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3557 - RNA, 4543 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3558 - RNA, 3619 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3559 - RNA, 4480 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3560 - RNA, 3562 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3561 - RNA, 4318 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3562 - RNA, 4351 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3563 - RNA, 3484 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3564 - RNA, 3562 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3565 - RNA, 3568 nt, Artificial Sequence
  Cas9 variant mRNA product
gggagagucccgcagucggcguccagcggcucugcuuguucgugugugugucguugcaggccuuauucaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3566 - RNA, 3268 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3567 - RNA, 3679 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3568 - RNA, 4237 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3569 - RNA, 4216 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3570 - RNA, 4530 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3571 - RNA, 5313 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3572 - RNA, 3585 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3573 - RNA, 4653 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3574 - RNA, 3729 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3575 - RNA, 4590 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3576 - RNA, 3672 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3577 - RNA, 4428 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3578 - RNA, 4461 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3579 - RNA, 3594 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3580 - RNA, 3672 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3581 - RNA, 3678 nt, Artificial Sequence
  Cas9 variant mRNA product
gggagaggcgcugccuacggagguggcagccaucuccuucucggcaucaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3582 - RNA, 3378 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3583 - RNA, 3789 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3584 - RNA, 4347 nt, Artificial Sequence
  Cpf1 variant mRNA product
gggagaggcgcugccuacggagguggcagccaucuccuucucggcaucaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3585 - RNA, 4326 nt, Artificial Sequence
  Cpf1 variant mRNA product
gggagaggcgcugccuacggagguggcagccaucuccuucucggcaucaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3586 - RNA, 4582 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3587 - RNA, 5365 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3588 - RNA, 3637 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3589 - RNA, 4705 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3590 - RNA, 3781 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3591 - RNA, 4642 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3592 - RNA, 3724 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3593 - RNA, 4480 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3594 - RNA, 4513 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3595 - RNA, 3646 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3596 - RNA, 3724 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3597 - RNA, 3730 nt, Artificial Sequence
  Cas9 variant mRNA product
ggggcgcugccuacggagguggcagccaucuccuucucggcaucaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3598 - RNA, 3430 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3599 - RNA, 3841 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3600 - RNA, 4399 nt, Artificial Sequence
  Cpf1 variant mRNA product
ggggcgcugccuacggagguggcagccaucuccuucucggcaucaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3601 - RNA, 4378 nt, Artificial Sequence
  Cpf1 variant mRNA product
ggggcgcugccuacggagguggcagccaucuccuucucggcaucaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3602 - RNA, 4484 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3603 - RNA, 5267 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3604 - RNA, 3539 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3605 - RNA, 4607 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3606 - RNA, 3683 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3607 - RNA, 4544 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3608 - RNA, 3626 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3609 - RNA, 4382 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3610 - RNA, 4415 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3611 - RNA, 3548 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3612 - RNA, 3626 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3613 - RNA, 3632 nt, Artificial Sequence
  Cas9 variant mRNA product
gggagagucccgcagucggcguccagcggcucugcuuguucgugugugugucguugcaggccuuauucaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3614 - RNA, 3332 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3615 - RNA, 3743 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3616 - RNA, 4301 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3617 - RNA, 4280 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3618 - RNA, 4581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3619 - RNA, 5364 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3620 - RNA, 3636 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3621 - RNA, 4704 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3622 - RNA, 3780 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3623 - RNA, 4641 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3624 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3625 - RNA, 4479 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3626 - RNA, 4512 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3627 - RNA, 3645 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3628 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3629 - RNA, 3729 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3630 - RNA, 3429 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3631 - RNA, 3840 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3632 - RNA, 4398 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3633 - RNA, 4377 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 3634 - RNA, 4517 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3635 - RNA, 5300 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3636 - RNA, 3572 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3637 - RNA, 4640 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3638 - RNA, 3716 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3639 - RNA, 4577 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3640 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3641 - RNA, 4415 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3642 - RNA, 4448 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3643 - RNA, 3581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3644 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3645 - RNA, 3665 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3646 - RNA, 3365 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3647 - RNA, 3776 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3648 - RNA, 4334 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3649 - RNA, 4313 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3650 - RNA, 4466 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3651 - RNA, 5249 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3652 - RNA, 3521 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3653 - RNA, 4589 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3654 - RNA, 3665 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3655 - RNA, 4526 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3656 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3657 - RNA, 4364 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3658 - RNA, 4397 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3659 - RNA, 3530 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3660 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3661 - RNA, 3614 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu
